(12) United States Patent
Finer et al.

(10) Patent No.: US 12,208,126 B2
(45) Date of Patent: Jan. 28, 2025

(54) ONCOLYTIC VIRAL VECTORS AND USES THEREOF

(71) Applicant: Virogin Biotech Canada Ltd., Richmond (CA)

(72) Inventors: Mitchell H. Finer, Cambridge, MA (US); Lorena Lerner, Cambridge, MA (US); Christophe Quéva, Cambridge, MA (US); Edward Kennedy, Cambridge, MA (US)

(73) Assignee: Virogin Biotech Canada Ltd., Richmond (CA)

( * ) Notice: Subject to any disclaimer, the term of this patent is extended or adjusted under 35 U.S.C. 154(b) by 0 days.

(21) Appl. No.: 18/165,770

(22) Filed: Feb. 7, 2023

(65) Prior Publication Data

US 2023/0241140 A1 Aug. 3, 2023

Related U.S. Application Data

(63) Continuation of application No. 16/633,653, filed as application No. PCT/US2018/043938 on Jul. 26, 2018, now Pat. No. 11,612,625.

(60) Provisional application No. 62/686,802, filed on Jun. 19, 2018, provisional application No. 62/537,359, filed on Jul. 26, 2017.

(51) Int. Cl.
| | |
|---|---|
| A61K 35/763 | (2015.01) |
| C12N 7/00 | (2006.01) |
| C12N 15/86 | (2006.01) |

(52) U.S. Cl.
CPC .............. *A61K 35/763* (2013.01); *C12N 7/00* (2013.01); *C12N 15/86* (2013.01); *C12N 2710/16632* (2013.01); *C12N 2710/16643* (2013.01)

(58) Field of Classification Search
CPC ........ A61K 35/763; C12N 7/00; C12N 15/86; C12N 2710/16632; C12N 2710/16643; C12N 2710/16645; C12N 2710/16671; C12N 2710/16761; C12N 9/22; A61P 35/00

See application file for complete search history.

(56) References Cited

U.S. PATENT DOCUMENTS

| | | | |
|---|---|---|---|
| 5,059,538 A | 10/1991 | Nozaki et al. |
| 5,399,363 A | 3/1995 | Liversidge et al. |
| 5,466,468 A | 11/1995 | Schneider et al. |
| 5,543,158 A | 8/1996 | Gref et al. |
| 5,641,515 A | 6/1997 | Ramtoola |
| 5,658,724 A | 8/1997 | DeLuca |
| 5,725,871 A | 3/1998 | Illum |
| 5,756,353 A | 5/1998 | Debs |
| 5,759,814 A | 6/1998 | Burke et al. |
| 5,780,045 A | 7/1998 | McQuinn et al. |
| 5,804,212 A | 9/1998 | Illum |
| 5,804,413 A | 9/1998 | DeLuca |
| 5,837,532 A | 11/1998 | Preston et al. |
| 5,849,571 A | 12/1998 | Glorioso et al. |
| 5,849,572 A | 12/1998 | Glorioso et al. |
| 5,879,934 A | 3/1999 | DeLuca |
| 5,998,174 A | 12/1999 | Glorioso et al. |
| 6,071,742 A | 6/2000 | Tracy et al. |
| 6,261,552 B1 | 7/2001 | DeLuca |
| 6,469,155 B1 | 10/2002 | Fiume et al. |
| 6,653,447 B1 | 11/2003 | Cosman et al. |
| 7,078,029 B2 | 7/2006 | DeLuca |
| 7,473,418 B2 | 1/2009 | Yu et al. |
| 7,514,252 B2 | 4/2009 | Chiocca et al. |
| 7,531,167 B2 | 5/2009 | Glorioso et al. |
| 8,129,167 B2 | 3/2012 | Cosman |
| 8,546,553 B2 | 10/2013 | Terns et al. |
| 8,957,036 B2 | 2/2015 | Cascio et al. |
| 8,980,246 B2 | 3/2015 | Kirn |
| 9,157,071 B2 | 10/2015 | Campadelli et al. |
| 9,226,977 B2 | 1/2016 | Kirn |
| 9,593,347 B2 | 3/2017 | Glorioso, III et al. |
| 9,919,062 B2 | 3/2018 | Kirn |
| 10,000,757 B2 | 6/2018 | Naldini et al. |
| 10,172,893 B2 | 1/2019 | Uchida et al. |
| 10,188,686 B2 | 1/2019 | Uchida et al. |
| 10,201,575 B2 | 2/2019 | Uchida et al. |
| 10,210,575 B1 | 2/2019 | Engelhorn |
| 10,391,132 B2 | 8/2019 | Greenberg et al. |

(Continued)

FOREIGN PATENT DOCUMENTS

| | | |
|---|---|---|
| AU | 2012322999 B2 | 8/2017 |
| AU | 2017206231 B2 | 2/2019 |

(Continued)

OTHER PUBLICATIONS

Adamiak et al., "Herpes Simplex Virus Type 2 Glycoprotein G is Targeted by the Sulfated Oligo- and Polysaccharide Inhibitors of Virus Attachment to Cells," Journal of Virology, 81(24), 13424-13434 (2007).

(Continued)

*Primary Examiner* — Rachel B Gill

(74) *Attorney, Agent, or Firm* — COOLEY LLP

(57) ABSTRACT

Oncolytic viral vectors that incorporate one or more of the following features: viral replication restriction by insertion of microRNA (miRNA) target sequences into the viral genome; disruption of oncogenic miRNA function; cancer microenvironment remodeling; and cancer cell targeting by incorporation of protease-activated antibodies into the viral particle. Such viral vectors can be used for the treatment and prevention of cancer.

23 Claims, 57 Drawing Sheets

Specification includes a Sequence Listing.

(56) References Cited

U.S. PATENT DOCUMENTS

| | | | |
|---|---|---|---|
| 10,537,621 B2 | 1/2020 | Jonjic | |
| 10,576,115 B2 | 3/2020 | Uchida et al. | |
| 10,696,727 B2 | 6/2020 | Cascio et al. | |
| 11,419,926 B2 | 8/2022 | Glorioso, III et al. | |
| 11,427,625 B2 | 8/2022 | Grandi et al. | |
| 11,452,750 B2 | 9/2022 | Greenberg et al. | |
| 11,612,625 B2 | 3/2023 | Finer et al. | |
| 2002/0037575 A1 | 3/2002 | Speck | |
| 2002/0187126 A1 | 12/2002 | Blaho et al. | |
| 2007/0161110 A1 | 7/2007 | Iida et al. | |
| 2008/0008686 A1 | 1/2008 | Yao | |
| 2008/0289058 A1 | 11/2008 | Cascio et al. | |
| 2009/0136452 A1 | 5/2009 | Zhou et al. | |
| 2010/0041737 A1 | 2/2010 | Naldini et al. | |
| 2010/0076057 A1 | 3/2010 | Sontheimer et al. | |
| 2010/0093617 A1 | 4/2010 | Barrangou et al. | |
| 2010/0104578 A1 | 4/2010 | Shafren | |
| 2010/0233141 A1 | 9/2010 | Polach et al. | |
| 2010/0257638 A1 | 10/2010 | Cai et al. | |
| 2011/0213017 A1 | 9/2011 | Cascio et al. | |
| 2011/0217739 A1 | 9/2011 | Terns et al. | |
| 2011/0300538 A1 | 12/2011 | Barrangou et al. | |
| 2012/0277120 A1 | 11/2012 | Serber et al. | |
| 2013/0011828 A1 | 1/2013 | Barrangou et al. | |
| 2013/0071430 A1 | 3/2013 | Nakamura et al. | |
| 2013/0096186 A1 | 4/2013 | Glorioso, III et al. | |
| 2013/0156808 A1 | 6/2013 | Jonjic | |
| 2013/0202639 A1 | 8/2013 | Kousoulas et al. | |
| 2013/0288251 A1 | 10/2013 | Horvath et al. | |
| 2014/0255313 A1 | 9/2014 | Vasiljeva et al. | |
| 2014/0363469 A1 | 12/2014 | Meyers et al. | |
| 2015/0017121 A1 | 1/2015 | Becher et al. | |
| 2016/0153000 A1 | 6/2016 | Glorioso et al. | |
| 2016/0175462 A1 | 6/2016 | Zhang et al. | |
| 2016/0250267 A1 | 9/2016 | Uchida et al. | |
| 2017/0000832 A1 | 1/2017 | Shafren et al. | |
| 2017/0035819 A1 | 2/2017 | Uchida et al. | |
| 2017/0036819 A1 | 2/2017 | Aguero-Hernandez et al. | |
| 2017/0042995 A1 | 2/2017 | Ali et al. | |
| 2017/0081384 A1 | 3/2017 | Cascio et al. | |
| 2017/0095531 A1* | 4/2017 | Schreiber | A61P 37/04 |
| 2017/0107537 A1 | 4/2017 | Glorioso, III et al. | |
| 2017/0157188 A1 | 6/2017 | Silvestre et al. | |
| 2017/0189514 A1 | 7/2017 | Glorioso, III et al. | |
| 2017/0274025 A1 | 9/2017 | Uchida et al. | |
| 2017/0274057 A1 | 9/2017 | Jonjic | |
| 2018/0169241 A1 | 6/2018 | Cantwell | |
| 2018/0169271 A1 | 6/2018 | Cantwell et al. | |
| 2018/0215794 A1 | 8/2018 | Russell et al. | |
| 2018/0318365 A1 | 11/2018 | Yeung et al. | |
| 2018/0339004 A1 | 11/2018 | Greenberg et al. | |
| 2019/0048082 A1 | 2/2019 | Evnin | |
| 2019/0070233 A1 | 3/2019 | Yeung et al. | |
| 2019/0201493 A1 | 7/2019 | Becher et al. | |
| 2019/0233536 A1* | 8/2019 | Champion | C12N 15/86 |
| 2019/0262410 A1 | 8/2019 | Uchida et al. | |
| 2020/0147156 A1 | 5/2020 | Greenberg et al. | |
| 2020/0206285 A1 | 7/2020 | Finer et al. | |
| 2020/0405792 A1 | 12/2020 | Zhou et al. | |
| 2021/0138007 A1 | 5/2021 | Uchida et al. | |
| 2021/0386807 A1 | 12/2021 | Uchida et al. | |
| 2022/0380735 A1 | 12/2022 | Kennedy et al. | |
| 2023/0115116 A1 | 4/2023 | Greenberg et al. | |

FOREIGN PATENT DOCUMENTS

| | | | |
|---|---|---|---|
| CA | 2476724 A1 | 9/2003 | |
| CA | 2850575 A1 | 4/2013 | |
| CA | 2928956 A1 | 5/2015 | |
| CN | 105008918 A | 10/2015 | |
| CN | 105793425 A | 7/2016 | |
| EP | 2591796 A1 | 5/2013 | |
| EP | 2766035 B1 | 3/2018 | |
| EP | 3351261 A1 | 7/2018 | |
| EP | 3426271 A1 | 1/2019 | |
| EP | 3441084 A1 | 2/2019 | |
| JP | 2001508294 A | 6/2001 | |
| JP | 2003518080 A | 6/2003 | |
| JP | 2009060907 A | 3/2009 | |
| KR | 20030047667 A | 6/2003 | |
| WO | WO-9102788 A1 | 3/1991 | |
| WO | WO-9604394 A1 | 2/1996 | |
| WO | WO-9815637 A1 | 4/1998 | |
| WO | WO-9906583 A1 | 2/1999 | |
| WO | WO-9960142 A2 | 11/1999 | |
| WO | WO-2005092374 A2 | 10/2005 | |
| WO | WO-2006017914 A1 | 2/2006 | |
| WO | WO-2007025097 A2 | 3/2007 | |
| WO | WO-2008021207 A2 | 2/2008 | |
| WO | WO-2008141151 A2 | 11/2008 | |
| WO | WO-2008143875 A1 | 11/2008 | |
| WO | WO-2009111892 A1 | 9/2009 | |
| WO | WO-2009130479 A2 | 10/2009 | |
| WO | WO-2009144755 A1 | 12/2009 | |
| WO | WO-2009148488 A2 | 12/2009 | |
| WO | WO-2009150431 A1 | 12/2009 | |
| WO | WO-2010011961 A2 | 1/2010 | |
| WO | WO-2010054108 A2 | 5/2010 | |
| WO | WO-2010054154 A2 | 5/2010 | |
| WO | WO-2010135242 A1 | 11/2010 | |
| WO | WO-2011125469 A1 | 10/2011 | |
| WO | WO-2011130749 A2 | 10/2011 | |
| WO | WO-2012006181 A2 | 1/2012 | |
| WO | WO-2012054726 A1 | 4/2012 | |
| WO | WO-2012149470 A1 | 11/2012 | |
| WO | WO-2012164565 A1 | 12/2012 | |
| WO | WO-2013004396 A2 | 1/2013 | |
| WO | WO-2013053775 A1 | 4/2013 | |
| WO | WO-2013098244 A1 | 7/2013 | |
| WO | WO-2013109604 A1 | 7/2013 | |
| WO | WO-2013126794 A1 | 8/2013 | |
| WO | WO-2013141680 A1 | 9/2013 | |
| WO | WO-2013142578 A1 | 9/2013 | |
| WO | WO-2014107599 A2 | 7/2014 | |
| WO | WO-2014204729 A1 | 12/2014 | |
| WO | WO-2015009952 A1 | 1/2015 | |
| WO | WO-2015066042 A1 | 5/2015 | |
| WO | WO-2016141320 A2 | 9/2016 | |
| WO | WO-2017059168 A1 | 4/2017 | |
| WO | WO-2017096201 A1 | 6/2017 | |
| WO | WO-2017103290 A1 | 6/2017 | |
| WO | WO-2017103291 A1 | 6/2017 | |
| WO | WO-2017118864 A1 | 7/2017 | |
| WO | WO-2017118865 A1 | 7/2017 | |
| WO | WO-2017118866 A1 | 7/2017 | |
| WO | WO-2017118867 A1 | 7/2017 | |
| WO | WO-2017132552 A1 | 8/2017 | |
| WO | WO-2017156349 A1 | 9/2017 | |
| WO | WO-2018026872 A1 | 2/2018 | |
| WO | WO-2018027316 A1 | 2/2018 | |
| WO | WO-2018049248 A1 | 3/2018 | |
| WO | WO-2018049261 A1 | 3/2018 | |
| WO | WO-2018085461 A1 | 5/2018 | |
| WO | WO-2018118819 A2 | 6/2018 | |
| WO | WO-2018118967 A1 | 6/2018 | |
| WO | WO-2018127713 A1 | 7/2018 | |
| WO | WO-2019014623 A1 | 1/2019 | |
| WO | WO-2019023483 A1 | 1/2019 | |
| WO | WO-2020186355 A1 | 9/2020 | |
| WO | WO-2020186356 A1 | 9/2020 | |
| WO | WO-2021072310 A1 | 4/2021 | |
| WO | WO-2021101796 A1 | 5/2021 | |

OTHER PUBLICATIONS

Aghi et al., "Oncolytic herpes virus with defective ICP6 specifically replicates in quiescent cells with homozygous genetic mutations in p16.," Oncogene, 27: 4249-4254 (2008).

Akashi, H., Gene expression and molecular evolution. Curr Opin Genet Dev. Dec. 2001;11(6):660-666.

Akimoto et al., "A new delivery system for 5-fluorouracil using prodrug and converting enzyme," J. Ophthalmol., 86(5): 581-586 (2002).

(56) References Cited

OTHER PUBLICATIONS

Alayo et al., "Glioblastoma infiltration of both tumor- and virus-antigen specific cytotoxic T cells correlates with experimental virotherapy responses," Sci Rep. (2020) 10:5095, 11 pages.
Amelio et al., "A Chromatin Insulator-Like Element in the Herpes Simplex Virus Type 1 Latency-Associated Transcript Region Binds CCCTC-Binding Factor and Displays Enhancer-Blocking and Silencing Activities," J. of Virology, 80(5): 2358-2368 (Mar. 2006).
Ames, H. M., et al. "MicroRNA profiling of low grade glial and glioneuronal tumors shows an independent role for cluster 14q32.31 member miR-487b," Mod Pathol., Feb. 2017, 30(2): 204-216, doi:10.1038/modpathol.2016.177, 21 pages.
Anderson et al., "Pseudotyping of Glycoprotein D-Deficient Herpes Simplex Virus Type 1 with Vesicular Stomatitis Virus Glycoprotein G Enable Mutant Virus Attachment and Entry," Journal of Virology, 74(5): 2481-2487 (Mar. 2000).
Argnani, R., et al., "Replication-competent herpes simplex vectors: design and applications," Gene Therapy (2005), vol. 12, pp. S170-S177.
Asano et al., "Humanization of the Bispecific Epidermal Growth Factor Receptor X CD3 Diabody and Its Efficacy as a Potential Clinical Reagent," Clin. Cancer Res., 12(13): 4036-4042 (Jul. 1, 2006).
Assi et al., "Gene Therapy for Brain Tumors: Basic Developments and Clinical Implementation," Neurosci. Lett., Oct. 11, 2012, 527(2): 71-77, 14 pages.
Aurelian, L. et al., "Oncolytic viruses as immunotherapy: progress and remaining challenges," OncoTargets and Therapy, 9, pp. 2627-2637 (May 2016).
Ausländer, S. et al., "A ligand-dependent hammerhead ribozyme switch for controlling mammalian gene expression," Molecular BioSystems, 6, pp. 807-814, DOI: 10.1039/b923076a (2010).
Baek et al., "Bispecific Adapter-Mediated Retargeting of a Receptor-Restricted HSV-1 Vector to CEA-Bearing Tumor Cells," Molecular Therapy, 19(3): 507-514 (Mar. 2011).
Baertsch et al., "MicroRNA-mediated multi-tissue detargeting of oncolytic measles virus," Cancer Gene Therapy, 21(9), 373-380 (Sep. 2014).
Banerjee, et al., "Herpes Simplex Virus: The Hostile Guest that Takes Over Your Home," Frontiers in Microbiology, 11:733, pp. 1-18 (2020).
Barrangou et al., "CRISPR provides acquired resistance against viruses in prokaryotes," Science. 315(5819):1709-12.2007.
Beilstein, K. et al., "Conditional Control of Mammalian Gene Expression by Tetracycline-Dependent Hammerhead Ribozymes," ACS Synthetic Biology, 4, pp. 526-534,dx.doi.org/10.1021/sb500270h (2015).
Bennett et al., "Comparison of safety, delivery, and efficacy of two oncolytic herpes viruses (G207 and NV1020) for peritoneal cancer," Cancer Gene Therapy, 9: 935-945 (2002).
Black, et al., "Herpes simplex virus-1 thymidine kinase mutants created by semi-random sequence mutagenesis improve prodrug-mediated tumor cell killing," Cancer Res. Apr. 1, 2001; 61(7):3022-3026.
Broberg et al., "Immune Response to Herpes Simplex Virus and 134.5 Deleted HSV Vectors ," Current Gene Therapy, 5: 523-530 (2005).
Brouns et al., "Small CRISPR RNAs guide antiviral defense in prokaryotes," Science, Aug. 15, 2008;321(5891):960-964 (9 total pages).
Brown, S. M. et al., "ICP 34.5 influences herpes simplex virus type 1 maturation and egress from infected cells in vitro," Journal of General Virology, 75, 3679-3686 (1994).
Burton, E. A., et al., "Use of the Herpes Simplex Viral Genome to Construct Gene Therapy Vectors," Methods in Molecular Medicine, Humana Press, vol. 76, pp. 1-31 (Jan. 2003).
Bzik et al., "Nucleotide Sequence of a Region of the Herpes Simplex Virus Type 1 gB Glycoprotein Gene: Mutations Affecting Rate of Virus Entry and Cell Fusion," Virology, 37: 185-190 (1984).

Cai et al., "Linker-Insertion Nonsense and Restriction-Site Deletion Mutations of the gB Glycoprotein Gene of Herpes Simplex Virus Type 1," Journal of Virology, 61(3): 714-721 (Mar. 1987).
Camacho, L. H., et al., "Phase 1 clinical trial of anti-CTLA4 human monoclonal antibody CP-675,206 in patients (pts) with advanced solid malignancies", Journal of Clinical Oncology (2004); 22(14_suppl): 2505; Abstract Only; 4 pages.
Campadelli-Fiume et al., "Rethinking herpes simplex virus: the way to oncolytic agents," Rev. Med. Viral., 21: 213-226 (2011).
Cao et al., "A functional study of miR-124 in the developing neural tube," Genes & Development, 21: 531-536 (2007).
Cattaneo et al., "Reprogrammed viruses as cancer therapeutics: targeted, armed and shielded" Nature Reviews Microbiology, Jul. 2008, 6(7): 529-540, 25 pages.
Cawood, R. et al., "Use of tissue-specific microRNA to control pathology of wild-type adenovirus without attenuation of its ability to kill cancer cells," PLOS Pathogens, May 2009, vol. 5(5): e1000440,10 pages.
Cheadle et al., "Cloning and expression of the variable regions of mouse myeloma protein MOPC315 in E. coli: recovery of active FV fragments.," Mol Immunol (1992) 29(1): 21-30.
Chen, S-H. et al., "Neither LAT nor Open Reading Frame P Mutations Increase Expression of Spliced or Intron-Containing ICP0 Transcripts in Mouse Ganglia Latently Infected with Herpes Simplex Virus", Journal of Virology, vol. 76, No. 10, pp. 4764-4772 (May 2002).
Cheng, J., et al., "Novel transcription regulatory sequences and factors of the immune evasion protein ICP47 (US12) of herpes simplex viruses," Virology Journal (2020), vol. 17:101, 11 pages, doi: 10.1186/s12985-020-01365-3.
Cherenkova et al., "Generation of recombinant adenoviruses and lentiviruses expressing angiogenic and neuroprotective factors using Gateway cloning technology," Cell Transplantology and Tissue Engineering, 2012, vol. 7, No. 3, 164-168 (with English abstract).
Chihara, N., et al., "Induction and Transcriptional Regulation of the Co-Inhibitory Gene Module in T Cells," Nature 2018, 558 (7710): 454-459, doi:10.1038/s41586-018-0206-z (Jun. 2018) (36 total pages).
Chiocca, et al., "First-in-human CAN-3110 (ICP-34.5 expressing HSV-1 oncolytic virus) in patients with recurrent high-grade glioma," DOI: 10.1200/JCO.2021.39.15_suppl.2009, Journal of Clinical Oncology, vol. 39, No. 15_suppl 2009-2009 (May 20, 2021), 2 pages.
Chou, J. et al., "Mapping of Herpes Simplex Virus-1 Neurovirulence to γ134.5, a Gene Nonessential for Growth in Culture," Science, vol. 250, Issue 4985, pp. 1262-1266, doi: 10.1126/science.2173860 (Nov. 1990).
Chumakov, P. M., Oncolytic viruses, Institute of Molecular Biology. V.A. Engelgard RAS, 10th Zilber lecture, Nov. 19, 2015, w/ English translation, 4 pages.
Cocchi et al., "The Ectodomain of a Novel Member of the Immunoglobulin Subfamily Related to the Poliovirus Receptor Has the Attributes of a Bona Fide Receptor for Herpes Simplex Virus Types 1 and 2 in Human Cells," Journal of Virology, 72(12): 9992-10002 (Dec. 1998).
Cocchi et al., "The Herpes Simplex Virus JMP Mutant Enters Receptor-Negative J Cells through a Novel Pathway Independent of the Known Receptors nectin1, HveA, and nectin2," Journal of Virology, 78(9): 4720-4729 (May 2004).
Cong et al., "Multiplex Genome Engineering Using CRISPR/Cas Systems", Science, Feb. 2013, 339: 819-823.
Conner et al., "A strategy for systemic delivery of the oncolytic herpes virus HSV1716: redirected tropism by antibody-binding sites incorporated on the virion surface as a glycoprotein D fusion protein," Gene Therapy, 15: 1579-1592 (2008).
Connolly et al., "Potential Nectin-1 Binding Site on Herpes Simplex Virus Glycoprotein D," Journal of Virology, 79(2): 1282-1295 (Jan. 2005).
Connolly et al., Structure-Based Analysis of the Herpes Simplex Virus Glycoprotein D Binding Site Present on Herpevirus Entry Mediator HveA (HVEM), Journal of Virology 76(21):10894-10904 (Nov. 2002).
Co-pending U.S. Appl. No. 60/917,752, inventor Cascio; et al, filed May 14, 2007, 22 pages.

(56) References Cited

OTHER PUBLICATIONS

Co-pending U.S. Appl. No. 61/325,137, inventor Glorioso; et al, filed Apr. 16, 2010, 67 pages.

Co-pending U.S. Appl. No. 61/847,405, inventor Glorioso; et al, filed Jul. 17, 2013, 48 pages.

Currier et al., "Efficacy and Safety of the Oncolytic Herpes Simplex VirusrRp450 Alone and Combined With Cyclophosphamide," Molecular Therapy, May 2008, 16(5): 879-885, 18 total pages.

Darmanis, S. et al., "Single-Cell RNA-Seq Analysis of Infiltrating Neoplastic Cells at the Migrating Front of Human Glioblastoma," Cell Reports, 21, 1399-1410, Supplemental Information, https://doi.org/10.1016/j.celrep.2017.10.030 (Oct. 2017) (30 total pages).

De Gruijl et al., "Arming oncolytic viruses to leverage antitumor immunity," Expert Opinion on Biological Therapy, (2015) 15:7, 959-971.

Deltcheva et al., "Crispr RNA maturation by trans-encoded small RNA and host factor RNase III," Nature, Mar. 31, 2011; 471(7340): 602-607 (19 total pages).

Deluca et al., "Nucleotide Sequences of Herpes Simplex Virus Type 1 (HSV-1) Affecting Virus Entry, Cell Fusion, and Production of Glycoprotein gB (VP7)," Virology, 122: 411-423 (1982).

Delwar et al., "Tumour-specific triple-regulated oncolytic herpes virus to target glioma," Oncotarget, 2016, vol. 7, No. 19, pp. 28658-28669.

Desai et al., "Incorporation of the Green Fluorescent Protein into the Herpes Simplex Virus Type 1 Capsid," Journal of Virology, 72(9): 7563-7568 (Sep. 1998).

Dmitrieva et al., "Chondroitinase ABC I-mediated enhancement of oncolytic virus spread and antitumor efficacy," Clin. Cancer Res., 17(6): 1362-1372 (2011).

Doronina et al., "Site-specific release of nascent chains from ribosomes at a sense codon," Molecular and Cellular Biology, 28(13): 4227-4239 (2008).

Edge et al., "A let-7 MicroRNA-sensitive Vesicular Stomatitis Virus Demonstrates Tumor-specific Replication," Molecular Therapy, 16(8): 1437-1443 (Aug. 2008).

Eisenring et al., "IL-12 initiates tumor rejection via lymphoid tissue-inducer cells bearing the natural cytotoxicity receptor NKp46," Nat Immunol., 2010;11(11):1030-8, including Online Methods, 1 page.

El-Andaloussi, N., et al., "Generation of an Adenovirus-Parvovirus Chimera with Enhanced Oncolytic Potential", Journal of Virology, The American Society for Microbiology, vol. 86, No. 19, pp. 10418-10431 (Oct. 2012).

Esko et al., "Animal Cell Mutants Defective in Glycosaminoglycan biosynthesis," Proc. Natl. Acad. Sci. USA, 82: 3197-3201 (May 1985).

European Patent Office, European Search Report in European Patent Application No. 17155129.4, dated May 30, 2017, 9 pages.

Extended European Search Report and Search Opinion for European Application No. 20184441.2, dated Jan. 12, 2021, 7 pages.

Extended European Search Report for Application EP22161034.8, mailed Oct. 17, 2022, 7 pages.

Extended European Search Report issued by the European Patent Office for Application No. 14859119.1, dated Apr. 19, 2017, 10 pages.

Fan et al., "Mapping sites of herpes simplex virus type 1 glycoprotein D that permit insertions and impact gD and gB receptors usage," Sci Rep. Mar. 3, 2017; 7:43712, 12 pages.

Fecci et al., "Systemic CTLA-4 Blockade Ameliorates Glioma-Induced Changes to the CD4+ T Cell Compartment without Affecting Regulatory T-Cell Function," Clin Cancer Res., 2007;13(7):2158-2167.

Ferretti, E., et al. "MicroRNA profiling in human medulloblastoma." International Journal of Cancer, vol. 124, Issue 3, pp. 568-577 (2009).

Frampton et al., "Equine Herpesvirus 1 Enters Cells by Two Different Pathways, and Infection Requires the Activation of the Cellular Kinase ROCK1," Journal of Virology, 81(20): 10879-10889 (2007).

Friedman et al., "Herpes Simplex Virus Oncolytic Therapy for Pediatric Malignancies" Molecular Therapy, 17(7): 1125-1135 (2009).

Friedman et al., "Oncolytic HSV-1 G207 Immunovirotherapy for Pediatric High-Grade Gliomas," N Engl J Med., 384(17):1613-1622 (Apr. 2021).

Friedman et al., "Enhanced Sensitivity of Patient-Derived Pediatric High-Grade Brain Tumor Xenografts to Oncolytic HSV-1 Virotherapy Correlates with Nectin-1 Expression," Sci. Rep. (2018) 8:13930, 10 pages.

Fu et al., "Construction of an oncolytic herpes simplex virus that precisely targets hepatocellular carcinoma cells," Molecular Therapy, Feb. 2012, vol. 20, No. 2, pp. 339-346, published online Dec. 6, 2011, doi:10.1038/mt.2011.265.

Fujioka et al., "Interleukin-18 protects mice against acute herpes simplex virus type 1 infection," Journal of Virology, 73(3): 2401-2409 (1999).

Fuller et al., "Anti-glycoprotein D Antibodies That Permit Adsorption but Block Infection by Herpes Simplex Virus 1 Prevent Virion-cell Fusion at the Cell Surface," Proc. Natl. Acad. Sci. USA, 84: 5454-5458 (Aug. 1987).

Fuller et al., "Neutralizing Antibodies Specific for Glycoprotein H of Herpes Simplex Virus Permit Viral Attachment to Cells but Prevent Penetration," Journal of Virology, 63(8): 3435-3443 (Aug. 1989).

Garneau, J.E. et al. (2010). "The CRISPR/Cas bacterial immune system cleaves bacteriophage and plasmid DNA," Nature 468:67-71 and 1 p. methods.

Gasiunas et al., "Cas9-crRNA ribonucleoprotein complex mediates specific DNA cleavage for adaptive immunity in bacteria," PNAS, Sep. 25, 2012, vol. 109, No. 39, pp. 15539-15540.

Gaur et al., "Characterization of microRNA expression levels and their biological correlates in human cancer cell lines," Cancer Res., 67(6): 2456-2468 (2007).

GenBank Accession No. MN136523.1; American Type Culture Collection (ATCC) Catalog No. VR-39, 52 pages, Aug. 11, 2019.

GenBank Reference No. D00627.1, Human coxsackievirus A9 genomic RNA, complete genome, strain: Griggs, Dec. 14, 2007 (online) (retrieved on Jul. 21, 2022) Retrieved from https://www.ncbi.nlm.nih.gov/nuccore/221214 (4 total pages).

GenBank Reference No. KT161266.1, Coxsackievirus A21 isolate JN12377/SD/CHN/2012/CVA21, complete genome, Dec. 15, 2015 (online) (retrieved on Jul. 21, 2022) Retrieved from https://www.ncbi.nlm.nih.gov/nuccore/930578064 (4 total pages).

GenBank Reference No. M33854.1, Coxsackievirus B3 (CVB3) complete genome, Jun. 29, 1999 (online) (retrieved on Jul. 21, 2022) Retrieved from https://www.ncbi.nlm.nih.gov/nuccore/323419 (4 total pages).

Geraghty et al., "Entry of Alphaherpesviruses Mediated by Poliovirus Receptor-Related Protein 1 and Poliovirus Receptor," Science, 280: 1618-1620 (Jun. 5, 1998).

Gibson, et al., "Enzymatic assembly of DNA molecules up to several hundred kilobases." Nature Methods (Apr. 12, 2009); 6(5): 343-345.

Gierasch et al., "Construction and Characterization of Bacterial Artificial Chromosomes Containing HSV-1 Strains 17 and KOS," Journal of Virological Methods, 135: 197-206 (2006).

Gossen and Bujard, "Tight control of gene expression in mammalian cells by tetracycline-responsive promoters". Proc Natl Acad Sci U S A, Jun. 15, 1992; 89(12): 5547-5551.

Grandi P., et al., "Design and application of oncolytic HSV vectors for glioblastoma therapy," Expert Rev. Neurother. Apr. 2009, 9(4): 505-517, 23 total pages.

Grossman et al., "Survival of Patients with Newly Diagnosed Glioblastoma Treated with Radiation and Temozolomide in Research Studies in the United States," Clinical Cancer Research 2010, 16: 2443-2449, 12 total pages.

Gu, F., "Diagnostic techniques for viral, rickettsial and chlamydial diseases," Beijing Medical University—China Union Medical University Joint Press, 1993, 6 pages.

Gubanova et al., "Oncolytic viruses in the therapy of gliomas," Mol Biol (Mosk), 46(6), pp. 874-886 (Nov.-Dec. 2012), ISSN: 0026-8984 (English abstract) (1 page).

(56) References Cited

OTHER PUBLICATIONS

Guzman et al., "Expression of entry receptor nectin-1 of Herpes simplex virus 1 and/or Herpes simplex virus 2 in normal and neoplastic human nervous system tissues," Acta Virol. 2006; 50(1):59-66.
Hale et al., "RNA-Guided RNA Cleavage by a CRISPR RNA-Cas Protein Complex," Cell 139, 945-956, Nov. 25, 2009.
He et al., "Targeting Glioblastoma Stem Cells: Cell Surface Markers," Current Medicinal Chemistry, 19: 6050-6055 (2012).
Henke et al., "microRNA-122 stimulates translation of hepatitis C virus RNA," EMBO J. (2008) 27:3300-3310.
Highlander et al., "Identification of mar Mutations in Herpes Simplex Virus Type 1 Glycoprotein B Which Alter Antigenic Structure and Function in Virus Penetration," Journal of Virology, 63(2): 730-738 (Feb. 1989).
Hodi, F. S. et al. "Improved survival with ipilimumab in patients with metastatic melanoma." New England Journal of Medicine 363.8 (2010): 711-723.
Hong et al. "Ectopic matrix metalloproteinase 9 expression in human brain tumor cells enhances oncolytic HSV vector infection," Gene Therapy 17:1200-1205 (2010).
Ikeda, K. et al., Oncolytic virus therapy of multiple tumors in the brain requires suppression of innate and elicited antiviral responses, Nature Medicine, vol. 5, No. 8, pp. 881-887 (Aug. 1999).
International Preliminary Report on Patentability issued by the International Searching Authority for Application No. PCT/US2011/032923, dated Oct. 16, 2012, 8 pages.
International Preliminary Report on Patentability issued by the International Searching Authority for Application No. PCT/US2014/062676, dated May 3, 2016, 5 pages.
International Preliminary Report on Patentability, mailed Apr. 12, 2022, for International Application No. PCT/US2020/055133 (13 total pages).
International Preliminary Report on Patentability, mailed Jan. 28, 2020, for International Application No. PCT/US2018/043938 (11 total pages).
International Preliminary Report on Patentability, mailed Jul. 31, 2018, for International Application No. PCT/US2017/015417 (9 total pages).
International Search Report and Written Opinion, dated May 19, 2017, for International Application No. PCT/US2017/015417 (15 total pages).
International Search Report and Written Opinion for International Application No. PCT/US2022/075767 dated Jan. 10, 2023, 20 pages.
International Search Report and Written Opinion issued by the International Searching Authority for Application No. PCT/US2011/032923, dated Mar. 28, 2012, 12 pages.
International Search Report and Written Opinion issued by the International Searching Authority for Application No. PCT/US2014/062676, dated Dec. 23, 2014, 9 pages.
International Search Report and Written Opinion, mailed Mar. 26, 2021, for International Application No. PCT/US2020/055133 (24 total pages).
International Search Report and Written Opinion of the International Searching Authority for International Application No. PCT/US2018/43938, dated Dec. 14, 2018, 16 pages.
Invitation to Pay Additional Fees, and, Where Applicable, Protest Fee, mailed Apr. 5, 2017, for International Application No. PCT/US2017/015417 (15 total pages).
Invitation to Pay Additional Fees, and, Where Applicable, Protest Fee, mailed Feb. 5, 2021, for International Application No. PCT/US2020/055133 (20 total pages).
Invitation to Pay Additional Fees, and, Where Applicable, Protest Fee, mailed Nov. 3, 2022, for International Application No. PCT/US2022/075767 (4 total pages).
Invitation to Pay Additional Fees, and, Where Applicable, Protest Fee, mailed Oct. 15, 2018, for International Application No. PCT/US2018/043938 (3 total pages).

Iorio et al., "microRNA involvement in human cancer," Carcinogenesis, 33(6): 1126-1133 (2012).
Ishida et al., "Enhanced cytotoxicity with a novel system combining the paclitaxel-2'-ethylcarbonate prodrug and an HSV amplicon with an attenuated replication-competent virus, HF10 as a helper virus," Cancer Letters, 288: 17-27 (2010).
Ishino et al., "Oncolytric Virus Therapy with HSV-1 for Hematologic Malignancies," Blood (2019), 134 (Supplement_1): 3242, 3 pages.
Jackson et al., "Crystal structure of the CRISPR RNA-guided surveillance complex from Escherichia coli," Science, Sep. 19, 2014; 345(6203): 1473-1479 (15 total pages).
Jackson et al, "Insertion Mutations in Herpes Simplex Virus 1 Glycoprotein H Reduce Cell Surface Expression, Slow the Rate of Cell Fusion, or Abrogate Functions in Cell Fusion and Viral Entry," Journal of Virology, 84(4): 2038-2046 (Feb. 2010).
Jenkins et al., "Deletion of the Herpes simplex 1 internal repeat sequences affects pathogenicity in the mouse," Frontiers in Bioscience, Oct. 1996, 1:a59-68, 17 total pages.
Jinek et al., "A programmable dual-RNA-guided DNA endonuclease in adaptive bacterial immunity," Science (Aug. 2012); 337(6096):816-821.
Jinek et al., "RNA-programmed genome editing in human cells," Elife. Jan. 29, 2013;2:e00471 (9 total pages).
Junejo et al., "Deletions and Duplication in Internal Inverted Repeat Sequence of Long Region/Unique Sequence of Long Region (IRL/UL) of Herpes Simplex Virus Type-i (HSV-i) Genome are not Evidently Associated with Intracranial and Foot-Pad Pathogenicity in Mouse Model," J. Pak. Med. Assoc., 45(4), pp. 95-98, 1995 (8 pages).
Kaji et al., "Virus-free induction of pluripotency and subsequent excision of reprogramming factors," Nature, Apr. 9, 2009, 458(7239): 771-775, 10 pages.
Kambara et al., "An oncolytic HSV-1 mutant expressing ICP34.5 under control of a nestin promoter increases survival of animals even when symptomatic from a brain tumor," Cancer Res., 65(7): 2832-2839 (2005).
Karpowicz et al., "E-Cadherin Regulates Neural Stem Cell Self-Renewal," The Journal of Neuroscience, Mar. 25, 2009, 29(12): 3885-3896.
Karsy et al., "Current Progress on Understanding MicroRNAs in Glioblastoma Multiforme.," Genes & Cancer, 3(1): 3-15 (2012).
Katoh et al., "Hedgehog signaling, epithelial-to-mesenchymal transition and miRNA (review)," International Journal of Molecular Medicine, 22: 271-275 (2008).
Kaur et al., "Oncolytic HSV-1 Virotherapy: Clinical Experience and Opportunities for Progress," Curr Pharm Biotechnol., Jul. 2012; 13(9): 1842-1851 (19 total pages).
Kelly et al., "Attenuation of Vesicular Stomatitis Virus Encephalitis through MicroRNA Targeting," Journal of Virology, Feb. 2010, vol. 84, No. 3, pp. 1550-1562.
Kelly et al., "Engineering microRNA responsiveness to decrease virus pathogenicity," Nature Medicine, Nov. 2008, vol. 14, No. 11, pp. 1277-1283.
Kennedy et al., "Design of an Interferon-Resistant Oncolytic HSV-1 Incorporating Redundant Safety Modalities for Improved Tolerability," Molecular Therapy: Oncolytics, vol. 18, pp. 476-490 (Sep. 2020).
Ketzer, Patrick, et al., "Artificial riboswitches for gene expression and replication control of DNA and RNA viruses," PNAS, www.pnas.org/cgi/doi/10.1073/pnas.1318563111, E554-E562 (Jan. 2014).
Klysik et al., "Acyclovir in the Treatment of Herpes Viruses—A Review," Curr Med Chem. 2020; 27(24):4118-4137.
Kosovsky et al., "Herpes Simplex Virus 1 (HSV-1) Strain HSZP Glycoprotein B Gene: Comparison of Mutations among Strains Differing in Virulence," Virus Genes, 20(1): 27-33 (2000).
Krisky et al., "Deletion of multiple immediate-early genes from herpes simplex virus reduces cytotoxicity and permits long-term gene expression in neurons," Gene Therapy 5:1593-1603 (1998).
Krisky et al., "Rapid method for construction of recombinant HSV gene transfer vectors," Gene Therapy, 4: 1120-1125 (1997).

(56) References Cited

OTHER PUBLICATIONS

Krummenacher et al., "Effects of Herpes Simplex Virus on Structure and Function of Nectin-1/HveC," Journal of Virology, Mar. 2002, 76(5): 2424-2433.
Kuan et al., "Increased Binding Affinity Enhances Targeting of Glioma Xenografts by EGFRVIII-Specific scFv," Int. J. Cancer, 88: 962-969 (2000).
Kumar et al., "Impaired microRNA processing enhances cellular transformation and tumorigenesis," Nature Genetics, 39(5): 673-677 (2007).
Kwon et al., "Soluble V Domain of Nectin-1/HveC Enables Entry of Herpes Simplex Virus Type 1 (HSV-1) into HSY-Resistant Cells by Binding to Viral Glycoprotein D," Journal of Virology, Jan. 2006, 80(1): 138-148.
Lavon et al., "Gliomas display a microRNA expression profile reminiscent of neural precursor cells," Neuro-Oncology, 12(5): 422-433 (2010).
Lee et al., "MicroRNA Regulation of Oncolytic Herpes Simplex Virus-1 for Selective Killing of Prostate Cancer Cells," Clin. Cancer Res., 15(16): 5126-5135 (2009).
Lee et al., "Transcriptional and Translational Dual-regulated Oncolytic Herpes Simplex Virus Type 1 for Targeting Prostate Tumors," Molecular Therapy, 2010; 18(5):929-935.
Li et al., "Identification of Functional Domains in Herpes Simplex Virus 2 Glycoprotein B," Journal of Virology, Apr. 2006, vol. 80, No. 8, pp. 3792-3800.
Li, J-M., et al., "MicroRNA-145 regulates oncolytic herpes simplex virus-1 for selective killing of human non-small cell lung cancer cells", Virology Journal 2013, 10(1): 241, pp. 1-9, published Jul. 22, 2013, http://www.virologyj.com/content/10/1/241.
Ligas et al., "A Herpes Simplex Virus Mutant in Which Glycoprotein D Sequences Are Replaced by beta-Galactosidase Sequences Binds to but Is Unable To Penetrate into Cells," Journal of Virology, May 1988, 62(5): 1486-1494.
Lilley et al., "Multiple Immediate-Early Gene-Deficient Herpes Simplex Virus Vectors Allowing Efficient Gene Delivery to Neurons in Culture and Widespread Gene Delivery to the Central Nervous System In Vivo," J. of Virology, 75:9: 4343-4356 (May 2001).
Linde, et al., "Treatment outcome of patients with recurrent glioblastoma multiforme: a retrospective multicenter analysis," Journal of Neuro-Oncology, vol. 135, pp. 183-192 (2017).
Liu B.L., et al., "ICP34.5 Deleted Herpes Simplex Virus with Enhanced Oncolytic, Immune Stimulating, and Anti-Tumour Properties," Gene Therapy 2003, 10, pp. 292-303.
Loakes et al., "5-Nitroindole as an universal base analogue," Nucleic Acids Research, 1994, 22(20): 4039-4043.
Lopez-Otin et al., "Emerging roles of proteases in tumour suppression," Nat Rev Cancer, 2007, 7(10):800-808.
Ma et al., "A novel HBV antisense RNA gene delivery system targeting hepatocellular carcinoma," World J Gastroenterol 9:463-467 (2003).
Macdonald et al., "Genome Sequence of Herpes Simplex Virus 1 Strain KOS," Journal of Virology, Jun. 2012, 86(11): 6371-6372.
Maclean, A. R. et al., "Herpes simplex virus type 1 deletion variants 1714 and 1716 pinpoint neurovirulence-related sequences in Glasgow strain 17+ between immediate early gene 1 and the 'a' sequence," Journal of General Virology, 72, 631-639 (1991).
Mali et al., "RNA-guided human genome engineering via Cas9", Science. Feb. 15, 2013; 339(6121): 823-6. Epub Jan. 3, 2013.
Mammoto et al., "Role of Collagen Matrix in Tumor Angiogenesis and Glioblastoma Multiforme Progression," The American Journal of Pathology, 183(4): 1293-1305 (2013).
Manickan et al., "Genetic immunization against herpes simplex virus. Protection is mediated by CD4+ T lymphocytes.," The Journal of Immunology, 155: 259-265 (1995).
Manservigi, R., et al., "HSV Recombinant Vectors for Gene Therapy," The Open Virology Journal, 2010, vol. 4, pp. 123-156.
Marraffini and Sontheimer, "CRISPR Interference Limits Horizontal Gene Transfer in Staphylococci by Targeting DNA," Science, Dec. 19, 2008; 322(5909): 1843-1845 (7 total pages).
Martin, N. T., et al., "Oncolytic Virus Combination Therapy: Killing One Bird with Two Stones", Molecular Therapy, vol. 26, No. 6, pp. 1414-1422 (Jun. 2018).
Mascanfroni, I. D., et al., "Metabolic control of type 1 regulatory T cell differentiation by AHR and HIF1-α," Nature Medicine, vol. 21, No. 6, pp. 638-646, including Online Methods, doi:10.1038/nm. 3868 (Jun. 2015), 12 total pages.
Mayo L., et al., "L-10-dependent Tr1 cells attenuate astrocyte activation and ameliorate chronic central nervous system inflammation," Brain (2016); 139(Pt 7):1939-1957.
Mazzacurati et al., "Use of miRNA response sequences to block off-target replication and increase the safety of an unattenuated, glioblastoma-targeted oncolytic HSV," Molecular Therapy, Jan. 2015, 23(1): 99-107.
McGeoch et al., "The Complete DNA Sequence of the Long Unique Region in the Genome of Herpes Simplex Virus Type 1," J. Gen. Virol. (1988), 69, 1531-1574.
Mckee et al., "Degradation of fibrillar collagen in a human melanoma xenograft improves the efficacy of an oncolytic herpes simplex virus vector," Cancer Research, 66(5): 2509-2513 (2006).
Melancon et al., "Herpes Simplex Virus Type 1 gK Is Required for gB-Mediated Virus-Induced Cell Fusion, While neither gB and gK nor gB and UL20p Function Redundantly in Virion De-Envelopment," J Virol. Jan. 2005; 79(1):299-313.
Menotti et al., "Construction of a Fully Retargeted Herpes Simplex Virus 1 Recombinant Capable of Entering Cells Solely via Human Epidermal Growth Factor Receptor 2," Journal of Virology, Oct. 2008, 82(20): 10153-10161.
Menotti, L., et al., "Inhibition of human tumor growth in mice by an oncolytic herpes simplex virus designed to target solely HER-2-positive cells," PNAS 106:9039-9044 (2009).
Metz et al., "Bispecific antibody derivatives with restricted binding functionalities that are activated by proteolytic processing," Protein Engineering, Design & Selection vol. 25 No. 10 pp. 571-580, 2012.
Miao et al., "EphA2 promotes infiltrative invasion of glioma stem cells in vivo through cross-talk with Akt and regulates stem cell properties," Oncogene, 34(5): 558-567 (2015) (23 total pages).
Miest et al., " New viruses for cancer therapy: meeting clinical needs," Nature Reviews Microbiology, Jan. 2014, 12(1): 23-34 , 29 pages.
Miller et al., "Development of a Syngenic Murine 816 Cell Line-Derived Melanoma Susceptible to Destruction by Neuroattenuated HSV-1," Molecular Therapy, 3(2), Feb. 2001, pp. 160-168.
Milne et al., "Glycoprotein D Receptor-Dependent, Low-pH-Independent Endocytic Entry of Herpes Simplex Virus Type 1," Journal of Virology, Jun. 2005, 79(11): 6655-6663.
Mohyeldin et al., "Gene and viral therapy for glioblastoma: a review of clinical trials and future directions," The Cancer Journal, 18(1): 82-88 (2012).
Mok et al., "Matrix Metalloproteinases-1 and -8 Improve the Distribution and Efficacy of an Oncolytic Virus," Cancer Res., 67(22): 10664-10668 (2007).
Montgomery et al., "Herpes Simplex Virus-1 Entry into Cells Mediated by a Novel Member of the TNF/NGF Receptor Family," Cell 87:427-436 (1996).
Mou, H., et al., "Conditional Regulation of Gene Expression by Ligand-Induced Occlusion of a MicroRNA Target Sequence, Molecular Therapy, vol. 26, No. 5, pp. 1277-1286 (May 2018).
Muggeridge, "Characterization of Cell-cell Fusion Mediated by Herpes Simplex Virus 2 glycoproteins gB, gD, gH and gL in Transfected Cells," Journal of General Virology, 81: 2017-2027 (2000).
Mulepati et al., "Crystal structure of a CRISPR RNA-guided surveillance complex bound to a ssDNA target," Science, Sep. 19, 2014; 345(6203): 1479-1484 (15 total pages).
Mullokandov et al. "High-throughput assessment of microRNA activity and function using microRNA sensor and decoy libraries," Nature Methods 2012, 9(8):840-846, 19 pages.
Nakano et al., "Mechanism of HSV infection through soluble adapter-mediated virus bridging to the EGF receptor," Virology 2011, 413: 12-18, 16 pages.

(56) References Cited

OTHER PUBLICATIONS

Navaratnarajah et al., "Targeted Entry of Enveloped Viruses: Measles and Herpes Simplex Virus I" Curr. Opin. Virol., Feb. 2012, 2(1): 43-49, 11 pages.
NCBI, "Chain A, Glycoprotein B From Herpes Simplex Virus Type 1" Database Entrez-Nucleotide, Accession No. 4L1R_A (Jun. 26, 2013). Retrieved on Mar. 5, 2018, 5 pages.
NCBI, "glycoprotein B [Human herpesvirus 1]," Database Entrez-Nucleotide, Accession No. AAA91805 (Mar. 8, 1996). Retrieved on Mar. 5, 2018, 1 page.
NCBI, "glycoprotein B [Human herpesvirus 1]," Database Entrez-Nucleotide, Accession No. AAF70301 (May 16, 2000). Retrieved on Mar. 5, 2018, 1 page.
NCBI, "glycoprotein B [Human herpesvirus 2]," Database Entrez-Nucleotide, Accession No. ABU45427 (Nov. 29, 2007). Retrieved on Mar. 5, 2018, 2 pages.
NCBI, "Herpes Simplex Virus Type 1 Gene for Glycoprotein gH," Database GenBank Accession No. X03896 (Apr. 18, 2005). Retrieved on Mar. 5, 2018, 3 pages.
NCBI, "Herpes Simplex Virus Type 1 Gene for Glycoprotein gH," Database GenBank Accession No. X03896 (Jul. 26, 2016). Retrieved on Mar. 5, 2018, 3 pages.
NCBI, "Human Herpesvirus 1 Complete Genome," Database GenBank Accession No. X14112 (Oct. 23, 2008). Retrieved on Mar. 5, 2018, 70 pages.
NCBI, "Human Herpesvirus 1 Strain KOS Glycoprotein B Gene," Database GenBank Accession No. AF311740 (Jan. 24, 2001). Retrieved on Mar. 5, 2018, 2 pages.
NCBI Reference Sequence: NC_001806.2, Human herpesvirus 1 strain 17, complete genome, Aug. 13, 2018, 62 pages.
Nduom et al., "Glioblastoma Cancer Stem-like Cells—Implications for Pathogenesis and Treatment," Cancer J., Jan. 2012, 18(1): 100-106, 16 pages.
Nicola and Strauss, "Cellular and Viral Requirements for Rapid Endocytic Entry of Herpes Simplex Virus," Journal of Virology, Jul. 2004, 78(14): 7508-7517.
Nicola et al., "Roles for Endocytosis and Low pH in Herpes Simplex Virus Entry into HeLa and Chinese Hamster Ovary Cells," Journal of Virology, May 2003, 77(9): 5324-5332.
Nomura, Y. et al., "Synthetic mammalian riboswitches based on guanine aptazyme," Chem. Commun., 48, 7215-7217, DOI: 10.1039/c2cc33140c (2012).
Ocana et al., "A new regulatory loop in cancer-cell invasion," Molecular Biology Organization, 9(6): 521-522 (2008).
O'Day et al., "Efficacy and safety of ipilimumab monotherapy in patients with pretreated advanced melanoma: a multicenter single-arm phase II study," Annals of Oncology, 2010 21:1712-1717.
Omidfar et al., "Production and Characterization of a New Antibody Specific for the Mutant EGF Receptor, EGFRvIII, in Camelus bactrianus," Tumor Biology, 25:179-187 (2004).
Omidfar et al., "Production of a Novel Camel Single-Domain Antibody Specific for the Type III Mutant EGFR," Tumor Biology, 25: 296-305 (2004).
Opalinska et al., "Nucleic-Acid Therapeutics: Basic Principles and Recent Applications," Nature Reviews, 1: 503-514 (2002).
Padfield et al., "Current therapeutic advances targeting EGFR and EGFRvIII in glioblastoma," Front Oncol. 2015; 5:5, 8 pages.
Parker et al., "Oncolytic viral therapy of malignant glioma," Neurotherapeutics: The Journal of the American Society for Experimental Neuro Therapeutics, 6: 558-569 (2009).
Patriarca et al., "Epithelial cell adhesion molecule expression (CD326) in cancer: a short review," Cancer Treatment Reviews, 38: 68-75 (2012).
Payne et al., "The pathobiology of collagens in glioma," Mol. Cancer Res., Oct. 2013, 11(10), 21 pages, doi: 10.1158/1541-7786. MCR-13-0236.
Pertel et al., "Cell Fusion Induced by Herpes Simplex Virus Glycoproteins gB, gD, and gH-gL Requires a gD Receptor but Not Necessarily Heparan Sulfate," Virology, 279: 313-324 (2001).

Peters, Cole et al., "Designing herpes viruses as oncolytics," Molecular Therapy—Molecular Therapy—Oncolytics (2015) 2, 15010; doi:10.1038/mto.2015.10 (14 total pages).
Postic et al., "KNOTTIN: the database of inhibitor cystine knot scaffold after 10 years, toward a systematic structure modeling," Nucleic Acids Res. Jan. 4, 2018; 46(D1): D454-D458.
Power, A. T., et al., "Taming the Trojan horse: optimizing dynamic carrier cell/oncolytic virus systems for cancer biotherapy," Gene Therapy, vol. 15, No. 10, pp. 772-779 (Mar. 2008).
Qi, L.S. et al., "Repurposing CRISPR as an RNA-guided platform for sequence-specific control of gene expression," Cell, Feb. 2013, 152(5): 1173-1183, doi: 10.1016/j.cell.2013.02.022 (22 pages).
Raag and Whitlow, "Single-chain Fvs.," FASEB (1995) 9(1):73-80.
Ran et al., "Genome engineering using the CRISPR-Cas9 system," Nat Protoc. Nov. 2013; 8(11):2281-2308 (49 total pages).
Rauch et al., "Mutations in Herpes Simplex Virus Glycoprotein D Distinguish Entry of Free Virus from Cell-Cell Spread," Journal of Virology, Dec. 2000, 74(24):11437-11446.
Richard et al., "The pUL37 tegument protein guides alpha-herpesvirus retrograde axonal transport to promote neuroinvasion," PLoS Pathogens, 2017, 13(12), e1006741, 32 pages.
Riddick et al., "Integration and analysis of genome-scale data from gliomas," Nature Reviews—Neurology, 7: 439-450 (2011).
Robertson, Lesley M. et al., "Peripheral replication and latency reactivation kinetics of the non-neurovirulent herpes simplex virus type 1 variant 1716," Journal of General Virology, vol. 73, pp. 967-970 (1992).
Russell, T., et al., Engineering herpes simplex viruses by infection-transfection methods including recombination site targeting by CRISP/Cas9 nucleases, Journal of Virological Methods, 2015, vol. 213, pp. 18-25.
Russell, T., et al., "Lytic Promoters Express Protein during Herpes Simplex Virus Latency," PLOS Pathogens, doi: 10.1371/journal. ppat.1005729 (Jun. 2016), 20 pages.
Saharkhiz-Langroodi and Holland, Identification of the Fusion-from-without Determinants of Herpes Simplex Virus Type 1 Glycoprotein B, Virology 227, 153-159 (1997).
Sapranauskas et al., "The *Streptococcus thermophilus* CRISPR/Cas system provides immunity in *Escherichia coli*," Nucleic Acids Research, vol. 39, Issue 21, pp. 9275-9282 (Nov. 2011).
Schaffer et al., "Temperature-Sensitive Mutants of Herpes Simplex Virus Type 1: Isolation, Complementation and Partial Characterization," Virology, 52: 57-71 (1973).
Segal, "Bacteria herald a new era of gene editing," eLife 2013; 2:e00563, DOI: 10.7554/eLife.00563 (3 total pages).
Sethi et al., "Protection of Mice from Fatal Herpes Simplex Virus Type 1 Infection by Adoptive Transfer of Cloned Virus-specific and H-2-restricted Cytotoxic T Lymphocytes," J. Gen. Viral., 64: 443-447 (1983).
Shi et al., "hsa-mir-181a and hsa-mir-181b function as tumor suppressors in human glioma cells," Brain Research, 1236: 185-193 (2008).
Shogan et al., "Virucidal Activity of a GT-Rich Oligonucleotide against Herpes Simplex Virus Mediated by Glycoprotein B," Journal of Virology, May 2006, 80(10): 4740-4747.
Silber et al., "miR-124 and miR-137 inhibit proliferation of glioblastoma multiforme cells and induce differentiation of brain tumor stem cells," BMC Medicine, 6(14): 1-17 (2008).
Simmons et al., "Local secretion of anti-CTLA-4 enhances the therapeutic efficacy of a cancer immunotherapy with reduced evidence of systemic autoimmunity," Cancer Immunol Immunother., 2008;57(8):1263-1270.
Sinkunas et al., "In vitro reconstitution of Cascade-mediated CRISPR immunity in *Streptococcus thermophilus*," The EMBO Journal (2013) 32, 385-394.
Slavuljica et al., "Recombinant mouse cytomegalovirus expressing a ligand for the NKG2d receptor is attenuated and has improved vaccine properties," J. Clin. Invest., Dec. 2010, 120(12): 4532-4545.
Smith, "Relationship Between the Envelope and the Infectivity of Herpes Simplex Virus," Herpes Virus Envelopes, 814-816 (1964).

(56) References Cited

OTHER PUBLICATIONS

Stamenkovic et al., "Extracellular matrix remodeling: the role of matrix metalloproteinases," Journal of Pathology, 2003, 200: 448-464.
Struyf et al., "Mutations in the N-Terminal Domains of Nectin-1 and Nectin-2 Reveal Differences in Requirements for Entry of Various Alphaherpesviruses and for Nectin-Nectin Interactions," Journal of Virology, Dec. 2002, 76(24): 12940-12950.
Supplementary Partial European Search Report and Search Opinion for European Application No. 18837388.0, dated Aug. 3, 2021, 9 pages.
Szymczak et al., "Development of 2A peptide-based strategies in the design of multicistronic vectors," Expert Opin. Biol. Ther., 5(5): 627-638 (2005).
Takenaga, M. et al., "Microparticle resins as a potential nasal drug delivery system for insulin", Journal of Controlled Release (1998), 52(Issues 1-2): 81-87.
Takenaka et al., "Control of tumor-associated macrophages and T cells in glioblastoma via AHR and CD39," Nat Neurosci May 2019; 22(5), 729-740.
Tarasova, M. V., et al., "Oncolytic viruses in the treatment of gliomas, study guide," Novosibirsk, 2015, 30 pages (with partial English translation).
Thomas et al., "Equine Herpesvirus 1 Gene 12 Can Substitute for vmw65 in the Growth of Herpes Simplex Virus (HSV) Type 1, Allowing the Generation of Optimized Cell Lines for the Propagation of HSV Vectors with Multiple Immediate-Early Gene Defects," J. of Virology, 73(9): 7399-7409 (Sep. 1999).
Tischer et al., "Two-step red-mediated recombination for versatile high-efficiency markerless DNA manipulation in *Escherichia coli.*," BioTechniques, 40(2): 191-196 (2006).
Tocchi et al., "Functional interactions between matrix metalloproteinases and glycosaminoglycans," FEBS Journal (2013) 280:2332-2341.
Todo, "Oncolytic Virus Therapy Using Genetically Engineered Herpes Simplex Viruses," Cell, 15(3): 151-159 (2002).
Todo, T., "Oncolytic virus therapy using genetically engineered herpes simplex viruses", Frontiers in Bioscience (Landmark Ed.), 13(6): 2060-2064 (Jan. 2008).
Topalian, S. L., et al., "Safety, Activity, and Immune Correlates of Anti-PD-1 Antibody in Cancer", New England Journal of Medicine (Jun. 28, 2012); 366(26): 2443-2454.
Triozzi et al., "Phase I Study of the Intratumoral Administration of Recombinant Canarypox Viruses Expressing B7.1 and Interleukin 12 in Patients with Metastatic Melanoma," Clin Cancer Res 2005;11(11):4168-4175.
Tsvitov et al., "Characterization of Soluble Glycoprotein D-mediated Herpes Simplex Virus Type 1 Infection," Virology, Apr. 10, 2007, 360(2): 477-491, 26 pages.
Turan, S., et al. Recombinase-mediated cassette exchange (RMCE)—A rapidly-expanding toolbox for targeted genomic modifications, Gene, vol. 515, No. 1, pp. 1-27 (Feb. 2013).
Turner et al., "Glycoproteins gB, gD, and gHgL of Herpes Simplex Virus Type 1 Are Necessary and Sufficient To Mediate Membrane Fusion in a Cos Cell Transfection System," Journal of Virology, Jan. 1998, 72(1): 873-875.
Uchida et al., "A Double Mutation in Glycoprotein gB Compensates for Ineffective gD-Dependent initiation of Herpes Simplex Virus Type 1 Infection," Journal of Virology, Dec. 2010, 84(23): 12200-12209.
Uchida et al., "Co-engineering of HSV-1 GB and gD Enables Efficient Retargeted Infection," 29th Annual Meeting of the American Society for Virology, slides of oral presentation, 38 pages, Bozeman, MT (Jul. 17-21, 2010).
Uchida et al., "Co-engineering of HSV-1 Glycoproteins B and D Enables Highly Efficient Retargeted Infection," 29th Annual Meeting of the American Society for Virology, abstract, 1 page, Bozeman, MT (Jul. 17-21, 2010).
Uchida et al., "Effective Treatment of an Orthotopic Xenograft Model of Human Glioblastoma Using an EGFR-retargeted Oncolytic Herpes Simplex Virus," Molecular Therapy 21(3):561-569 (2013).
Uchida et al., "Fully Retargeted HSV-1 Infection Directed by Re-Engineered Glycoprotein D (gD) Is Augmented by Hyperactive gB Mutations," Molecular Therapy, 18(Supp. 1): S249, Abstract 640 (May 2010).
Uchida et al., "Generation of Herpes virus Entry Mediator (HVEM)-Restricted Herpes Simplex Virus Type 1 Mutant Viruses: Resistance of HVEM-Expressing Cells and Identification of Mutations That Rescue Nectin-1 Recognition," Journal of Virology, Apr. 2009, 83(7): 2951-2961.
Uchida et al., "Hyperactive gB Mutations Augment Fully Retargeted HSV Infection," 13 Annual Meeting of the American Society of Gene & Cell Therapy, slides of oral presentation, 34 pages, Washington, DC (May 19-22, 2010).
Uchida et al., "Hyperactive gB Mutations Augment Fully Retargeted HSV Infection," 35th Annual International Herpes Virus Workshop, poster presentation, 1 page, Salt Lake City, UT (Jul. 24-29, 2010).
Uchida et al., "Hyperactive Glycoprotein B (gB) Mutations Augment Fully Retargeted Herpes Simplex Virus (HSV) Infection," 101 Annual Meeting of the American Association for Cancer Research, poster presentation, 1 page, Washington, DC (Apr. 18, 2010).
Uchida et al., "Hyperactive Glycoprotein B Mutations Augment Fully Retargeted HSV Infection," 35th Annual International Herpes Virus Workshop, abstract, 1 page, Salt Lake City, UT (Jul. 24-29, 2010).
Uchida et al., "Identification of Mutations in HSV-1 Envelope Glycoprotein B That Enhance Retargeted Infection," Proceedings of the American Association for Cancer Research, 51: 139, Abstract 584 (Apr. 2010).
U.S. Appl. No. 61/562,738, inventor Jonjic, filed Nov. 22, 2011, 239 pages.
U.S. Patent Office, International Search Report in International Patent Application No. PCT/US2017/037531, 4 DD. (Sep. 29, 2017).
U.S. Patent Office, Written Opinion in International Patent Application No. PCT/US2017/037531, 4 pp. (Sep. 29, 2017).
Ushijima et al., "Determination and Analysis of the DNA Sequence of Highly Attenuated Herpes Simplex Virus Type 1 Mutant HF10, a Potential Oncolylic Virus," Microbes and Infection, 9: 142-149 (2007).
Varghese et al., "Oncolytic herpes simplex virus vectors for cancer virotherapy," Cancer Gene Therapy, 9(12): 967-978 (2002).
Verhaak, R. G. W., et al., "An integrated genomic analysis identifies clinically relevant subtypes of glioblastoma characterized by abnormalities in PDGFRA, IDH1, EGFR and NF1," Cancer Cell, Jan. 19, 2010, 17(1): 98, 25 pages, doi: 10.1016/j.ccr.2009.12.020.
Visvanathan et al., "The microRNA miR-124 antagonizes the antineural REST/SCP1 pathway during embryonic CNS development," Genes & Development, 21: 744-749 (2007).
Voeks et al., "Gene therapy for prostate cancer delivered by ovine adenovirus and mediated by purine nucleoside phosphorylase and fludarabine in mouse models," Gene Therapy, 9(12): 759-768 (2002).
Wahid, F. et al., "MicroRNAs: Synthesis, mechanism, function, and recent clinical trials", Biochimica et Biophysica Acta, vol. 1803, Issue 11, pp. 1231-1243 (Nov. 2010).
Wakimoto et al., "Effects of innate immunity on herpes simplex virus and its ability to kill tumor cells," Gene Therapy, 10: 983-990 (2003).
Wang, W., et al., "Evaluation of miR-122-regulated suicide gene therapy for hepatocellular carcinoma in an orthotopic mouse model.", Chin. J. Cancer Res., 25(6), pp. 646-655, 2013.
Warner et al., "A Cell Surface Protein with Herpesvirus Entry Activity (HveB) Confers Susceptibility to Infection by Mutants of Herpes Simplex Virus Type 1, Herpes Simples Virus Type 2, and Pseudorabies Virus," Virology, 246: 179-189 (1998).
Whittman, A. and Suess, B., "Selection of tetracycline inducible self-cleaving ribozymes as synthetic devices for gene regulation in yeast," Molecular Biosystems, 7, pp. 2419-2427 (2011).

(56) References Cited

OTHER PUBLICATIONS

Wikstrand et al., "Monoclonal Antibodies against EGFRvIII Are Tumor Specific and React with Breast and Lung Carcinomas and Malignant Gliomas," Cancer Research, 55: 3140-3148 (Jul. 15, 1995).

Win and Smolke, "A modular and extensible RNA-based gene-regulatory platform for engineering cellular function," PNAS, vol. 104, No. 36, pp. 14283-14288 (Sep. 2007), and one page correction dated 2009.

Wollman et al., "Oncolytic Virus Therapy for Glioblastoma Multiforme: Concepts and Candidates," Cancer J. 2012; 18(1): 69-81, 26 pages, doi: 10.1097/PPO.0b013e31824671c9.

Wong et al., "Targeted oncolytic herpes simplex viruses for aggressive cancers," Current Pharmaceutical Biotechnology 2012, vol. 13, No. 7, 9 pages.

Xia et al., "Loss of Brain-enriched miR-124 MicroRNA Enhances Stem-like Traits and Invasiveness of Glioma Cells," The Journal of Biological Chemistry, 287(13): 9962-9971 (2012).

Xiao, H. et al., "Structural Basis for Specific, High-Affinity Tetracycline Binding by an In Vitro Evolved Aptamer and Artificial Riboswitch," Chemistry & Biology, vol. 15, Issue 10, pp. 1125-1137 (Oct. 2008).

Yan et al. "Effective small RNA destruction by the expression of a short tandem target mimic in *Arabidopsis*," The Plant Cell 24:415-427 (Feb. 2012).

Yin et al., "The treatment of glioblastomas: A systematic update on clinical Phase III trials," Critical Reviews in Oncology/Hematology, 87: 265-282 (2013).

Yun, "Overcoming the extracellular matrix barrier to improve intratumoral spread and therapeutic potential of oncolytic virotherapy," Current Opinion in Molecular Therapeutics, 10(4): 356-361 (2008).

Zaharoff, D. A., et al., "Intratumoral Immunotherapy of Established Solid Tumors with Chitosan/IL-12," J Immunother. Sep. 2010, 33(7): 697-705, 18 pages, doi: 10.1097/CJI.0b013e3181eb826d.

Zeng, Y., "HIV and related viruses," Nankai University Press, 1999, 5 pages.

Zetsche et al., "Cpf1 is a single RNA-guided endonuclease of a Class 2 CRISPR-Cas system", Cell (Oct. 2015); 163(3): 759-771.

Zhang et al., "Abstract 3669: IDH mutant glial cell resistance to natural killer cell cytotoxicity," Cancer Research 2014, 74, 3669, published Oct. 2014, doi: 10.1158/1538-7445.AM2014-3669.

Zhang, et al., "Intravesical treatment of advanced urothelial bladder cancers with oncolytic HSV-1 co-regulated by differentially expressed microRNAs," Gene Therapy (2016), vol. 23, No. 5, pp. 460-468, doi: 10.1038/gt.2016.18.

Zhang et al., "MicroRNA-128 inhibits glioma cells proliferation by targeting transcription factor E2F3a," J. Mol Med., 87: 43-51 (2009).

Zhong et al., "Induction, Selection and Expansion of Acute Myeloid Leukemia Reactive Autologous T Cells for Adoptive Immunotherapy," Blood, Nov. 2005, 106(11):1061, 2 pages.

Zhong, G. et al., "Rational design of aptazyme riboswitches for efficient control of gene expression in mammalian cells", eLIFE,5:e18858, doi: 10.7554/eLife.18858 (Nov. 2016) (17 total pages).

Zhou and Roizman, "Construction and properties of a herpes simplex virus 1 designed to enter cells solely via the IL-13α2 receptor," PNAS, Apr. 4, 2006, 103(14):5508-5513.

European Patent Office, Office Action in European Patent Application No. 17155129.4, 7 pp. (Mar. 27, 2018).

\* cited by examiner

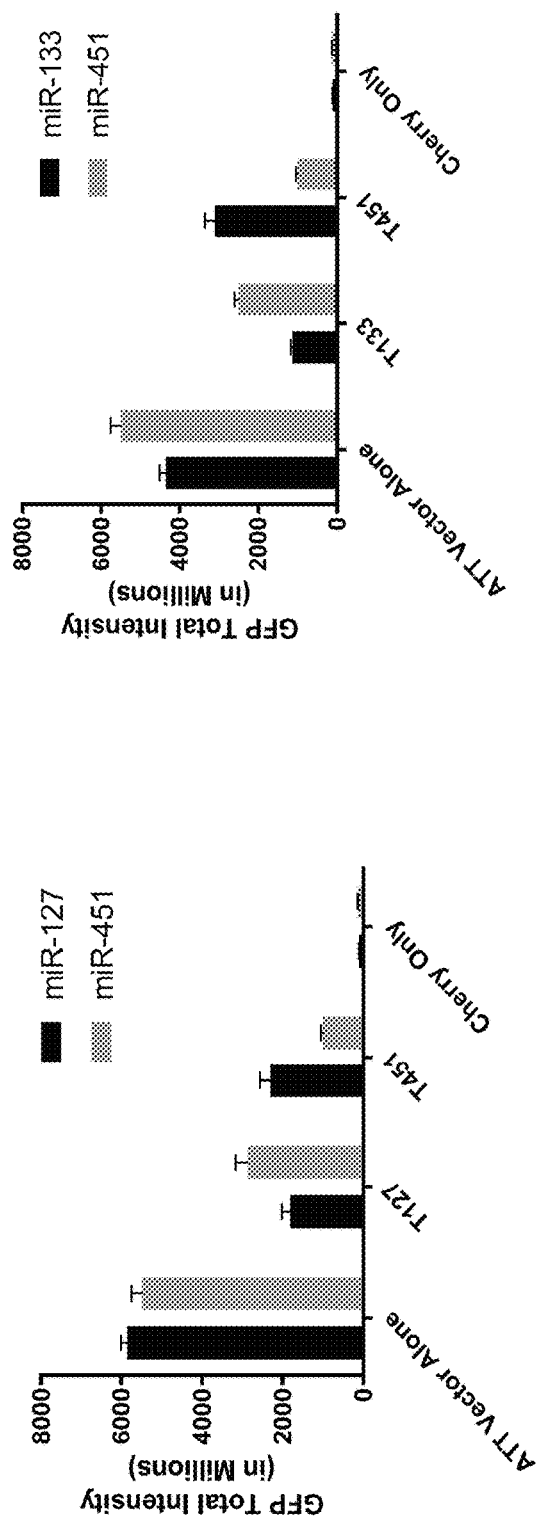
Fig. 24
Fig. 25
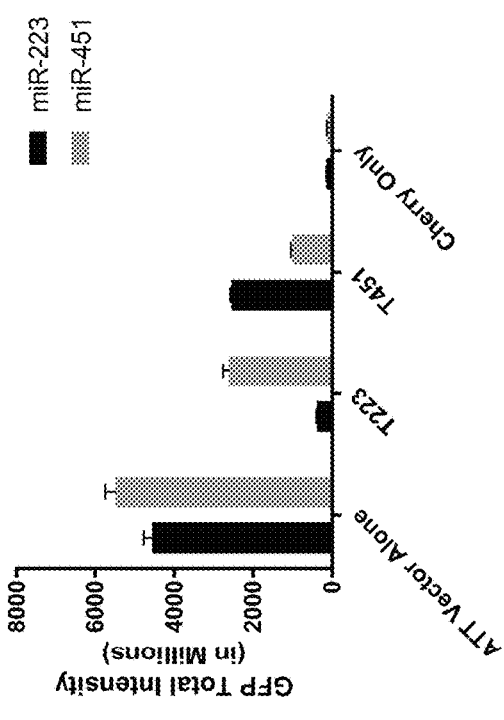
Fig. 26

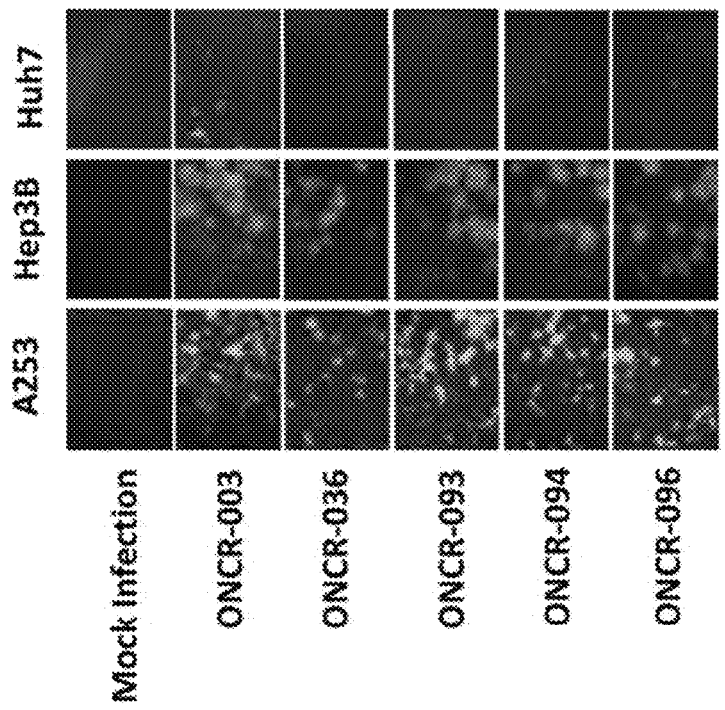
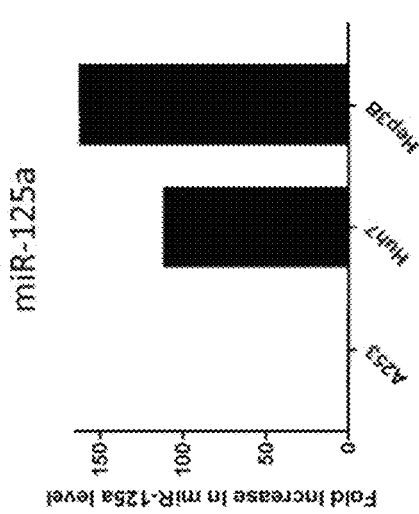
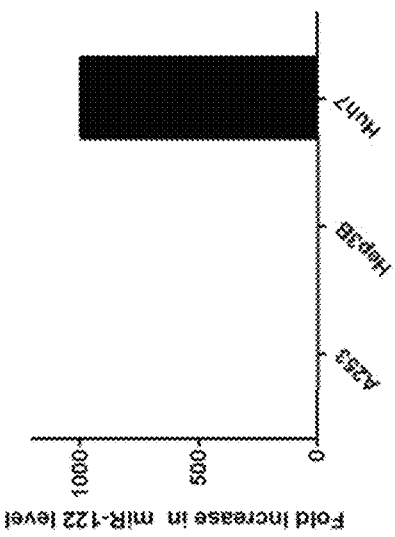

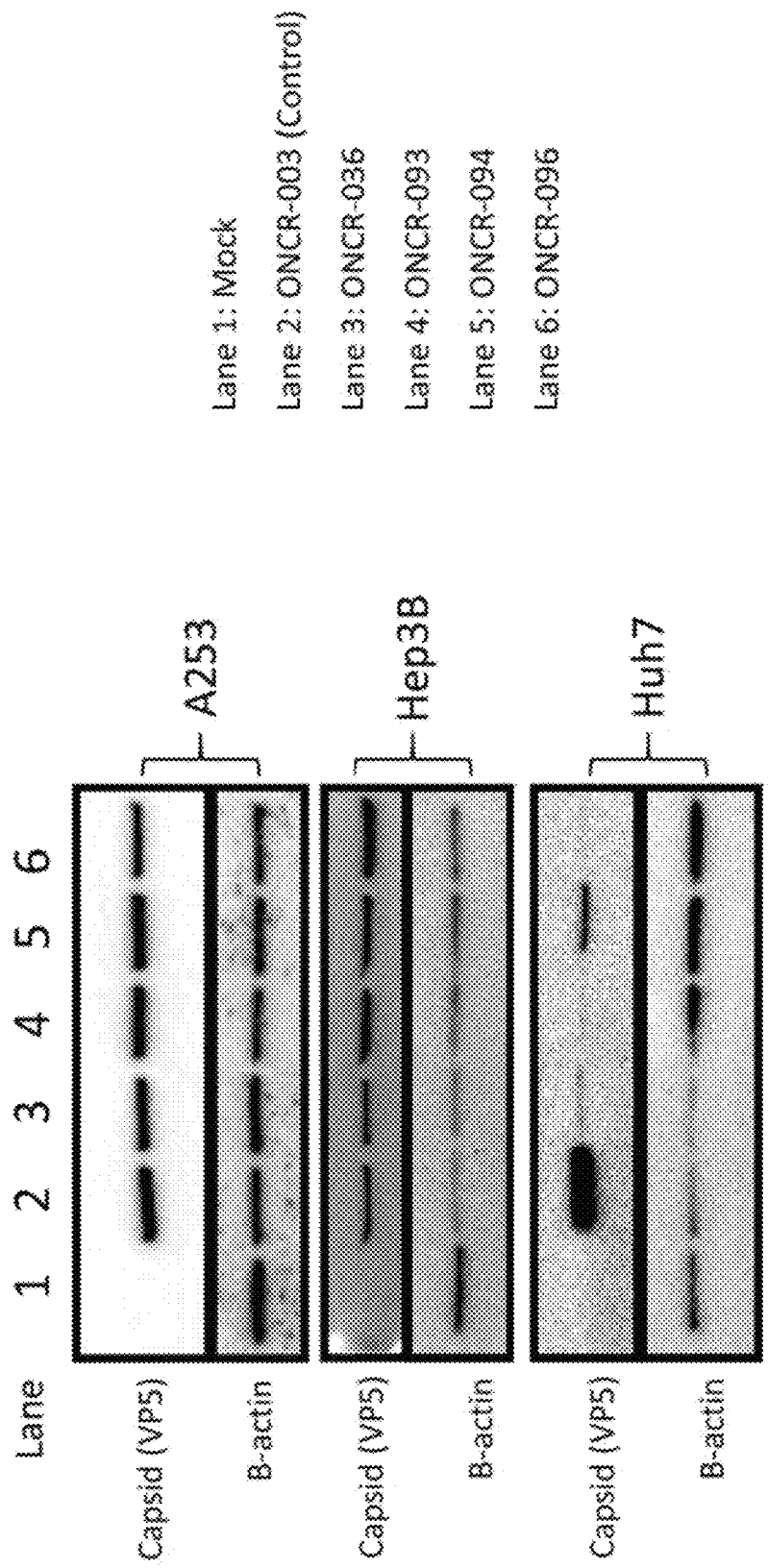

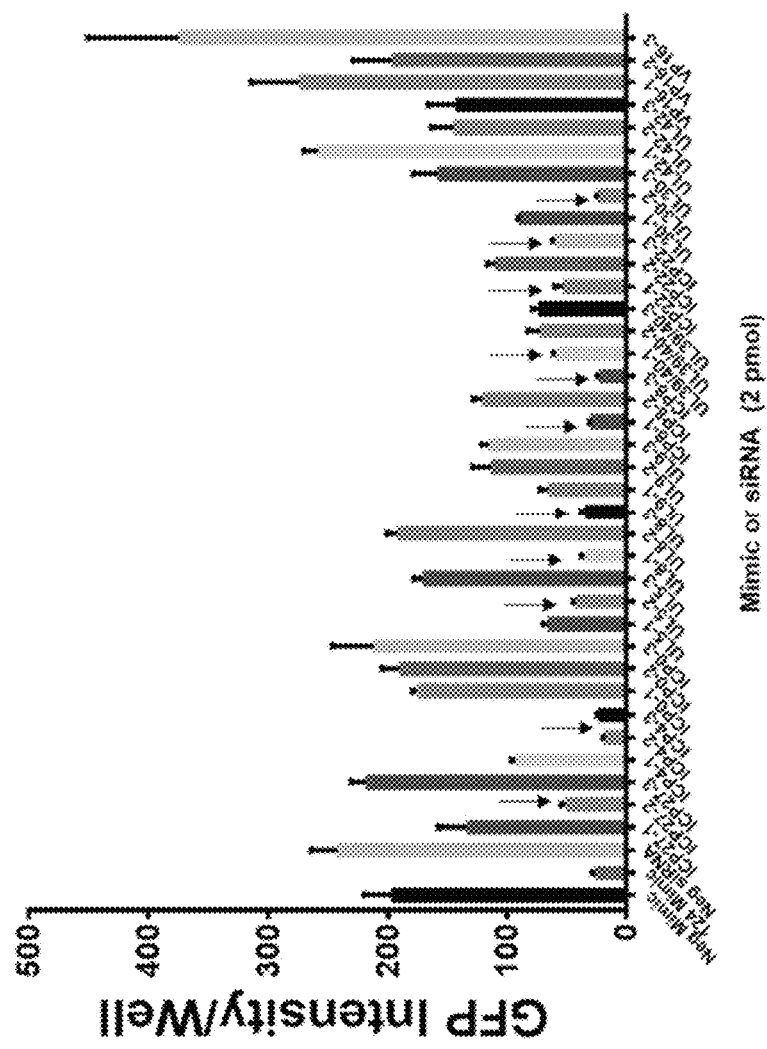

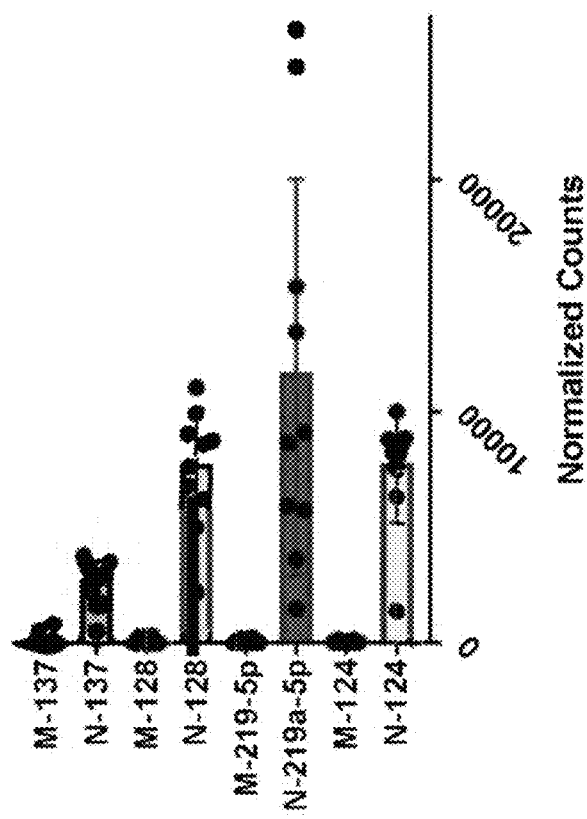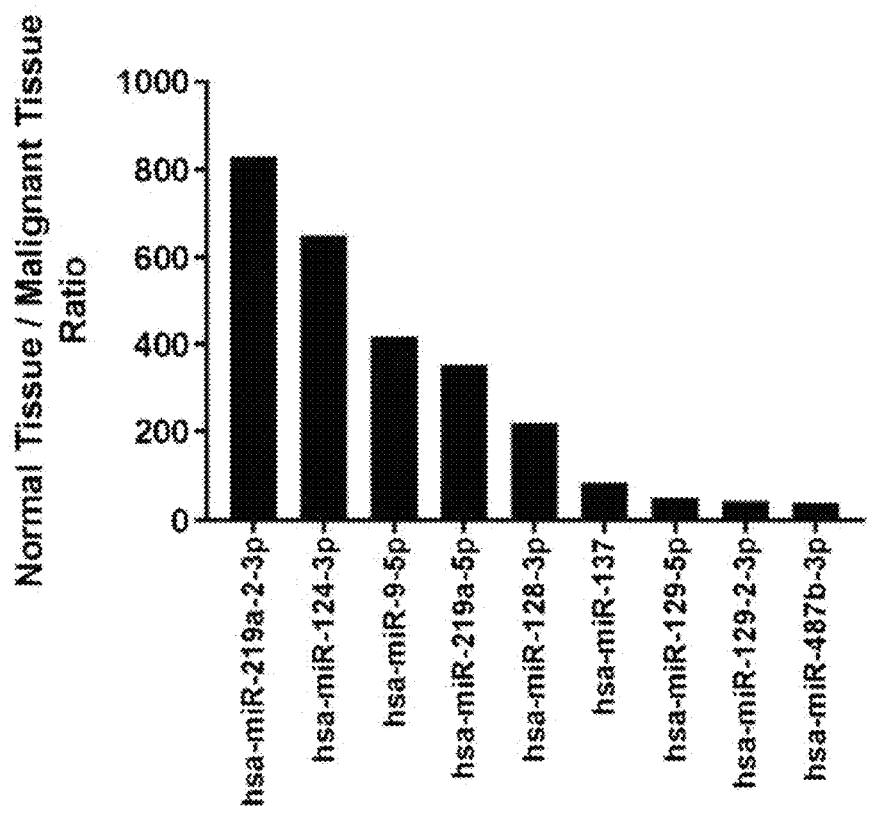
*Fig. 50B*
*Fig. 50A*

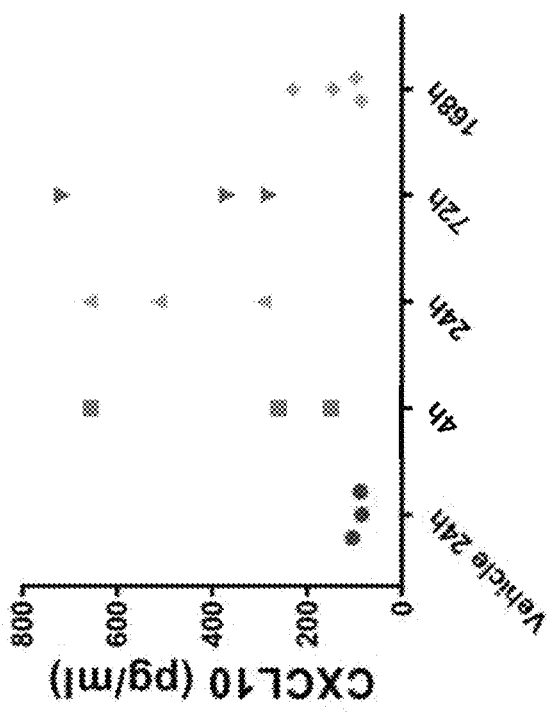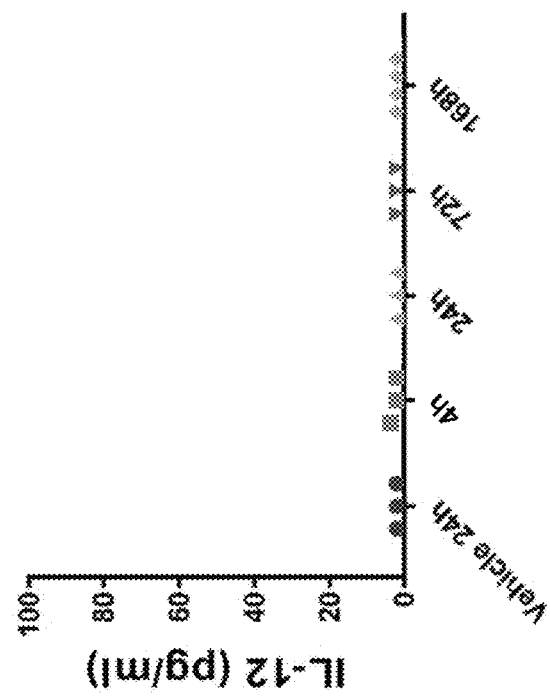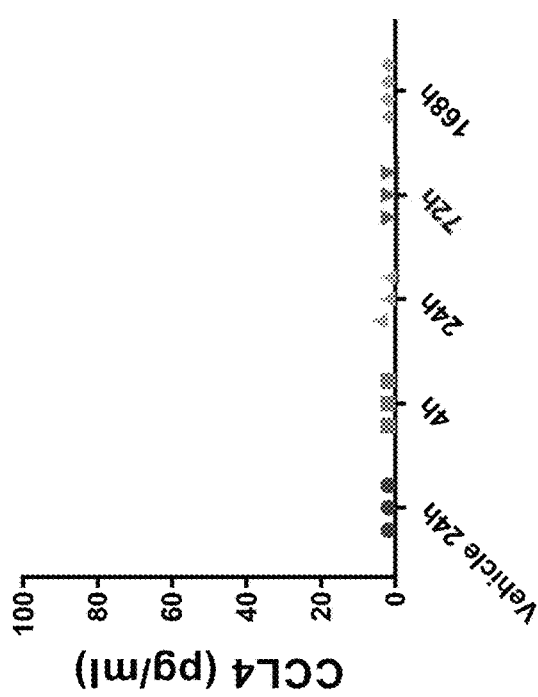
Fig. 61A
Fig. 61B
Fig. 61C

ONCOLYTIC VIRAL VECTORS AND USES THEREOF

REFERENCE TO RELATED APPLICATIONS

This application is a continuation of U.S. patent application Ser. No. 16/633,653, filed Jan. 24, 2020, which is a national phase filing under 35 U.S.C. § 371 of International Patent Application No. PCT/US2018/043938, filed Jul. 26, 2018, which claims the benefit of priority to U.S. Provisional Application No. 62/537,359, filed Jul. 26, 2017; and U.S. Provisional Application No. 62/686,802, filed Jun. 19, 2018, the disclosures of which are each incorporated herein by reference in their entireties.

STATEMENT REGARDING SEQUENCE LISTING

The Sequence Listing associated with this application is provided in text format in lieu of a paper copy, and is hereby incorporated by reference into the specification. The name of the text file containing the Sequence Listing is ONCR_010_03US_SubSeqList_ST26.xml. The text file is 1,055,453 bytes, created on Feb. 7, 2023, and is being submitted electronically via EFS-Web.

FIELD

The present disclosure relates to recombinant viral vectors for the treatment and prevention of cancer. In particular, the disclosure relates to oncolytic viral vectors.

BACKGROUND

Current targeted cancer therapeutics are efficacious in only a narrow range of cancers due to the heterogeneity of tumor protein expression profiles. Furthermore, many cancer treatments, including existing viral vectors, chemotherapy, radiation, and surgery lack the specificity to selectively treat cancerous cells, while maintaining the health and viability of normal, non-cancerous cells and can produce undesirable off-target effects. As such, there is a need in the art for cancer therapies that are broadly efficacious in multiple cancers and are capable of selectively eliminating cancerous cells.

Oncolytic viruses are viruses that preferentially infect cancer cells and have been used in multiple pre-clinical and clinical studies for cancer treatment. Use of oncolytic viruses carries the risk of non-specific viral infection of healthy cells, leading to the death of non-cancerous cells and tissues. However, genetic manipulation of the viruses to exploit pathways, proteins, and genes that are differentially expressed in normal vs. cancerous tissue can increase the specificity of these viruses and limit off-target infection and cell death.

MicroRNAs (miRNAs or miRs) are small non-coding endogenous RNAs that regulate gene expression by directing their target messenger RNAs for degradation or translational repression. miRs are intimately associated with normal cellular processes and therefore, deregulation of miRNAs contributes to a wide array of diseases including cancer. Many miR genes are located in cancer associated genomic regions, or in fragile sites, further strengthening the evidence that miRs play a pivotal role in cancer. miRs are differentially expressed in cancer tissues compared to normal tissues and can have a causative relationship to tumorigenesis. By exploiting this differential miR expression in diverse tumor types, the cancer therapeutics described herein possess a broad spectrum safety and efficacy profile, wherein oncolytic viral replication is regulated based on the expression of a particular miR or group of miRs. Further, the oncolytic viruses described herein may also express proteins that facilitate viral spread throughout a tumor, such as those altering the expression of genes and proteins that regulate the extracellular matrix, thereby increasing their therapeutic efficacy.

There remains a need in the art for improved oncolytic viral vectors. The present disclosure provides such improved oncolytic viral vectors, and more.

SUMMARY

The present disclosure provides oncolytic viral vectors that exhibit improved technical effects compared to the prior art. The present inventors have designed various oncolytic viral vectors and performed extensive experiments, described herein, to identify oncolytic viral vectors with superior properties for clinical use in treatment of cancer.

The invention relates to recombinant viral vectors that are useful for the treatment and prevention of cancer. The oncolytic viral vectors described herein are capable of restricting viral vector replication to cancer or tumor cells by virtue of microRNA (miR) target sequences that are inserted into the viral genome. In particular embodiments described herein, the viral vectors comprise two, three, four or more copies of a miR target sequence incorporated into one or more essential viral genes. In further embodiments, the viral vectors comprise incorporation of one or more polynucleotide sequences into the viral genome whose product(s) disrupt the function of an oncogenic miR and/or alter the extracellular matrix. In further embodiments, the viral vectors comprise protease-activated antibodies incorporated into the viral particle, thereby allowing for highly selective targeting of the vectors to cancer/tumor cells. Compositions of the viral vectors and methods of use in killing of cancerous cells and the treatment of cancer are further provided herein.

In an embodiment, the present disclosure provides a recombinant oncolytic herpes simplex virus (HSV) comprising at least two micro-RNA (miRNA) target sequence inserted into a locus of one or more essential viral genes, wherein the one or more viral genes are selected from the group consisting of ICP4, ICP27, ICP8, ICP22, ICP34.5, UL5, UL8, UL9, UL30, UL39/40, and UL42. In an embodiment, the replication of the recombinant HSV is reduced in a non-cancerous cell compared to the replication of the recombinant HSV in a cancerous cell of the same cell type. In an embodiment, the one or more viral genes are selected from the group consisting of ICP8, ICP22, ICP34.5, UL5, UL8, UL9, UL30, UL39/40, and UL42. In an embodiment, the one or more viral genes are selected from the group consisting of UL8, ICP8, and UL30. In an embodiment, the one or more viral genes are selected from the group consisting of ICP27 and ICP4. In an embodiment, the one or more viral genes are selected from the group consisting of ICP4, ICP27, UL8, UL42, and ICP34.5.

In an embodiment, the cell is selected from the group consisting of a neuronal cell, a cardiac cell, a muscle cell, and a liver cell. In an embodiment, the neuronal cell is a central nervous system cell, a peripheral nervous system cell, a brain cell, or a spinal cord cell. In an embodiment, the muscle cell is a striated muscle cell or a smooth muscle cell. In an embodiment, the non-cancerous cell and the cancerous cell are brain cells, and the at least two miRNA target sequences are target sequences for an miRNA selected from the group consisting of miR-137, miR-219a, miR-124, miR-9, miR-487b, and miR-128. In an embodiment, the at least two miRNA target sequences are target sequences for an miRNA selected from the group consisting of miR-137, miR-219a, miR-124, and miR-128 In an embodiment, the non-cancerous cell and the cancerous cell are cardiac or striated muscle cells, and the at least two miRNA target sequences are target sequences for an miRNA selected from the group consisting of miR-208b, miR-1, miR-208a, miR-133a, miR-4284, miR-499a, miR-126, miR-30e, miR-378i, miR-30b, and miR-378. In an embodiment, the at least two miRNA target sequences are target sequences for an miRNA selected from the group consisting of miR-208b, miR-1, and miR-208a In an embodiment, the non-cancerous cell and the cancerous cell are spinal cord cells, and the at least two miRNA target sequences are target sequences for an miRNA selected from the group consisting of miR-219a, miR-9, miR-204, miR-577, miR-99a, miR-100, miR-132, and miR-135. In an embodiment, the at least two miRNA target sequences are target sequences for an miRNA selected from the group consisting of miR-219a, miR-9, and miR-204. In an embodiment, the non-cancerous cell and the cancerous cell are peripheral nervous system cells, and the at least two miRNA target sequences are target sequences for an miRNA selected from the group consisting of miR-204, miR-1, miR-206, miR-9, miR-99a, miR-199b, miR-145, miR-100, miR-574. In an embodiment, the non-cancerous cell and the cancerous cell are liver cells, and the at least two miRNA target sequences are target sequences for an miRNA selected from the group consisting of miR-122 and miR-126. In an embodiment, the non-cancerous cell and the cancerous cell are smooth muscle cells, and the at least two miRNA target sequences are target sequences for an miRNA selected from the group consisting of miR-143 and miR-145.

In an embodiment, the two or more miR target sequences are incorporated into a miR-T cassette that is inserted in the 5' untranslated region (UTR) or 3' UTR of the one or more essential viral genes. In an embodiment, the miR-T cassette comprises a length of less than 1000 nucleotides. In an embodiment, the miR-T cassette comprises a length of between about 25 and about 500 nucleotides. In an embodiment, the miR-T cassette comprises a length of between about 100 and about 500 nucleotides.

In an embodiment, the present disclosure provides a recombinant oncolytic herpes simplex virus (HSV) comprising: (i) a first microRNA (miRNA) target sequence cassette (miR-TS cassette) inserted into a first viral gene and comprising at least 2 target sequences for each of miR-124, miR-1, and miR-143; (ii) a second miR-TS cassette inserted into a second viral gene and comprising at least 2 target sequences for each of miR-128, miR-219a, and miR-122; and (iii) a third miR-TS cassette inserted into a third viral gene and comprising at least 2 target sequences for each of miR-219a, miR-204, and miR-128. In an embodiment, the recombinant HSV further comprises a fourth miR-TS cassette inserted into a fourth viral gene, wherein the fourth miR-TS cassette comprises: (a) at least 2 target sequences for each of miR-137, miR-208b-3p, and miR-126; or (b) at least 2 target sequences for each of miR-137, miR-217, and miR-126.

In an embodiment, each of the miR-TS cassettes comprises 4 target sequences for each of the respectively miR-NAs. In an embodiment, the first viral gene is ICP4. In an embodiment, the second viral gene is ICP27. In an embodiment, the third viral gene is ICP34.5. In an embodiment, the fourth viral gene is UL8. In an embodiment, the replication of the recombinant HSV is reduced in a non-cancerous cell compared to the replication of the recombinant HSV in a cancerous cell of the same cell type, wherein the cell is selected from the group consisting of a neuronal cell, a cardiac cell, a muscle cell, and a liver cell.

In an embodiment, the first miR-TS cassette comprises a nucleic acid sequence that is at least 95% identical to SEQ ID NO: 852. In an embodiment, the first miR-TS cassette comprises or consists of the nucleic acid sequence of SEQ ID NO: 852. In an embodiment, the second miR-TS cassette comprises a nucleic acid sequence that is at least 95% identical to SEQ ID NO: 853. In an embodiment, the second miR-TS cassette comprises or consists of the nucleic acid sequence of SEQ ID NO: 853. In an embodiment, the third miR-TS cassette comprises a nucleic acid sequence that is at least 95% identical to SEQ ID NO: 854. In an embodiment, the third miR-TS cassette comprises or consists of the nucleic acid sequence of SEQ ID NO: 854. In an embodiment, the fourth miR-TS cassette comprises a nucleic acid sequence that is at least 95% identical to SEQ ID NO: 855. In an embodiment, the fourth miR-TS cassette comprises or consists of the nucleic acid sequence of SEQ ID NO: 855.

In an embodiment, the recombinant HSV further comprises a heterologous polynucleotide sequence encoding one or more payload molecules. In an embodiment, the heterologous polynucleotide sequence encodes a payload selected from the group consisting of IL-12, CCL4, and CXCL10. In an embodiment, the heterologous polynucleotide sequence encodes two or more payloads selected from the group consisting of IL-12, CCL4, and CXCL10. In an embodiment, the heterologous polynucleotide sequence encodes three payloads comprising IL-12, CCL4, and CXCL10.

In an embodiment, the present disclosure provides a recombinant oncolytic virus comprising one or more microRNA (miR) target sequences inserted into a locus of one or more viral genes required for viral replication, wherein the virus is herpes simplex virus (HSV), and wherein the one or more viral genes are selected from the group consisting of UL8, ICP34.5, UL42, UL19, ICP4, and ICP27. In an embodiment, the one or more miR target sequences is incorporated into the 5' untranslated region (UTR) or 3' UTR of the one or more viral genes required for viral replication. In an embodiment, the miR target sequence is a target sequence for a miR selected from the group consisting of miR-122, miR-184, miR-34a, let7a, miR-145-5p, miR-199a-5p, miR-451a, miR-125a, miR-125a-5p, miR-126-3p, miR-233-3p, miR-143-3p, miR-1-3p, miR-133a-3p, miR-127a-3p, miR-133b, miR-134-3p, miR-124, miR-101, miR-125b, miR-145, miR-559, miR-213, miR-31-5p, and miR-205p.

In an embodiment, one or more copies of the one or more miR target sequences are inserted into a locus of one or more viral genes. In an embodiment, two, three, four, or more copies of the one or more miR target sequences are inserted into a locus of one or more viral genes. In an embodiment, replication of the virus is reduced or attenuated in a first cell compared to replication of the virus in a second cell, wherein the first cell has an increased expression of a miR capable of binding to the one or more miR target sequences compared to the expression of the miR in the second cell. In an embodiment, the expression level of the miR in the first cell is at least 5% greater than the expression level of the miR in the second cell. In an embodiment, the first cell is a non-cancerous cell. In an embodiment, the second cell has a reduced expression of a miR capable of binding to the one or more miR target sequences compared to the expression of the miR in the first cell. In an embodiment, the expression level of the miR in the second cell is at least 5% less than the expression level of the miR in the first cell. In an embodiment, the second cell is a cancerous cell.

In an embodiment, one copy of a miR-122 target sequence is inserted into the locus of one or more viral genes required for viral replication. In an embodiment, four copies of the miR-122 target sequence are inserted into the locus of one or more viral genes required for viral replication. In an embodiment, the one or more viral genes is ICP27. In an embodiment, one copy of a miR-125a target sequence inserted into the locus of one or more viral genes required for viral replication. In an embodiment, four copies of the miR-125a target sequence are inserted into the locus of one or more viral genes required for viral replication. In an embodiment, the one or more viral genes is UL42. In an embodiment, four copies of a miR-122 target sequence are inserted into the locus of ICP27 and one copy of a miR-125a target sequence is inserted into the locus of UL42. In an embodiment, one copy of a miR-122 target sequence is inserted into the locus of ICP27 and one copy of a miR-125a target sequence is inserted into the locus of UL42. In an embodiment, one copy of a miR-122 target sequence is inserted into the locus of ICP27 and three copies of a miR-125a target sequence are inserted into the locus of UL42. In an embodiment, four copies of a miR-122 target sequence are inserted into the locus of ICP27 and four copies of a miR-125a target sequence are inserted into the locus of UL42.

In an embodiment, the present disclosure provides a recombinant oncolytic virus comprising: (a) one or more micro-RNA (miR) target sequences inserted into a locus of one or more viral genes required for viral replication; and (b) one or more polynucleotides encoding (i) one or more proteins or oligonucleotides, wherein the proteins or oligonucleotides reduce the expression or inhibit the function of a miR, a gene, or a tissue inhibitor of metalloproteinases (TIMP); or (ii) a protease-activated antibody; wherein the virus is an HSV, wherein the one or more viral genes are selected from the group consisting of UL42, UL19, ICP4, and ICP27. In an embodiment, the miR is an oncogenic miR or a microenvironment remodeling miR. In an embodiment, oncogenic miR is selected from the miRs listed in Table 4. In an embodiment, the gene is an oncogenic gene. In an embodiment, the oncogenic gene is selected from the genes listed in Table 7. In an embodiment, the microenvironment remodeling miR is selected from the miRs listed in Table 5. In an embodiment, the one or more miR target sequences is incorporated into the 5' untranslated region (UTR) or 3' UTR of the one or more viral genes required for viral replication. In an embodiment, the miR target sequence is a target sequence for a miR selected from the group consisting of miR-122, miR-184, miR-34a, let7a, miR-145-5p, miR-199a-5p, miR-451a, miR-125a, miR-125a-5p, miR-126-3p, miR-233-3p, miR-143-3p, miR-1-3p, miR-133a-3p, miR-127a-3p, miR-133b, miR-134-3p, miR-124, miR-101, miR-125b, miR-145, miR-559, miR-213, miR-31-5p, and miR-205p.

In an embodiment, one or more copies of the one or more miR target sequences are inserted into a locus of one or more viral genes. In an embodiment, two, three, four, or more copies of the one or more miR target sequences are inserted into a locus of one or more viral genes. In an embodiment, one copy of a miR-122 target sequence is inserted into the locus of one or more viral genes required for viral replication. In an embodiment, four copies of the miR-122 target sequence are inserted into the locus of one or more viral genes required for viral replication. In an embodiment, the one or more viral genes is ICP27. In an embodiment, one copy of a miR-125a target sequence is inserted into the locus of one or more viral genes required for viral replication. In an embodiment, four copies of the miR-125a target sequence are inserted into the locus of one or more viral genes required for viral replication. In an embodiment, the one or more viral genes is UL42. In an embodiment, four copies of a miR-122 target sequence are inserted into the locus of ICP27 and one copy of a miR-125a target sequence is inserted into the locus of UL42. In an embodiment, one copy of a miR-122 target sequence is inserted into the locus of ICP27 and one copy of a miR-125a target sequence is inserted into the locus of UL42. In an embodiment, one copy of a miR-122 target sequence is inserted into the locus of ICP27 and three copies of a miR-125a target sequence are inserted into the locus of UL42. In an embodiment, four copies of a miR-122 target sequence are inserted into the locus of ICP27 and four copies of a miR-125a target sequence are inserted into the locus of UL42.

In an embodiment, the TIMP is selected from TIMP1, TIMP2, TIMP3 and TIMP4. In an embodiment, the oligonucleotide is an shRNA or a decoy oligonucleotide. In an embodiment, the protein is a nuclease, a bispecific T-cell engager (BiTE), an anti-immunosuppressive protein, or an immunogenic antigen. In an embodiment, the nuclease is selected from a Clustered Regulatory Interspaced Short Palindromic Repeats (CRISPR)-associated endonuclease, a zinc-finger nuclease (ZFN) or a transcription activator-like effector nuclease (TALEN). In an embodiment, the CRISPR-associated endonuclease is selected from SpCas9, SpCas9-HF1, SpCas9-HF2, SpCas9-HF3, SpCas9-HF4, SaCas9, FnCpf, FnCas9, eSpCas9, C2C1, C2C3, Cpf1, Cas1, Cas1B, Cas2, Cas3, Cas4, Cas5, Cas6, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, and Csf4. In an embodiment, the recombinant virus further comprises a heterologous polynucleotide encoding an tracr-RNA (trRNA) and a crispr-RNA (crRNA), wherein the crRNA is targeted to a genomic DNA sequence encoding a miR or a TIMP and wherein the trRNA facilitates binding and activation of a CRISPR-associated endonuclease.

In an embodiment, the anti-immunosuppressive protein is an anti-regulatory T-cell (Treg) protein or an anti-myeloid-derived suppressor cell (MDSC) protein. In an embodiment, the anti-immunosuppressive protein is a VHH-derived blocker or a VHH-derived BITE. In an embodiment, the protein induces an anti-tumor immune response. In an embodiment, the protein binds to an antigen expressed on a cell surface, wherein the antigen is selected from the group consisting of EpCAM, CTLA-4, PD1, FGF2, FGFR/FGFR2b, endothelin B Receptor, and SEMA4D. In an embodiment, the protein is selected from, folate, IFNβ, A2A, CCL5, CD137, CD200, CD38, CD44, CSF-1R, CXCL10, CXCL13, IL-12, IL-15, IL-2, IL-21, IL-35, ISRE7, LFA-1, NG2 (also known as SPEG4), a SMAD protein, STING, TGFβ, and VCAM1. In an embodiment, the at least one protease-activated antibody is incorporated into a viral glycoprotein envelope. In an embodiment, the protease-activated antibody is activated by a protease selected from a cysteine cathepsin, an aspartic cathepsin, a kallikrein (hK), a serine protease, a caspase, a matrix metalloproteinase (MMP), and a disintegrin metalloproteinase (ADAM). In an embodiment, the protease is selected from cathepsin K, cathepsin B, cathepsin L, cathepsin E, cathepsin D, hK1, PSA (hK3), hK10, hK15, uPA, uPAR, MMP-1, MMP-2, MMP-3, MMP-7, MMP-8, MMP-9, MMP-10, MMP-11, MMP-12, MMP-13, MMP-14, MMP-15, MMP-16, MMP-17, MMP-18, MMP-19, MMP-20, MMP-21, MMP-23A, MMP-23B, MMP-24, MMP-25, MMP-26, MMP-27, MMP-28, or a protease listed in Table 6. In an embodiment, the protease-activated antibody binds to a protein expressed more highly by a cancer cell or in a cancer microenvironment than by a non-cancer cell or in a non-cancer microenvironment. In an embodiment, the protease-activated antibody binds NKG2D, c-met, HGFR, CD8, heparan sulfate, VSPG4 (also known as NG2), EGFR, EGFRvIII, CD133, CXCR4, carcinoembryonic antigen (CEA), CLC-3, annexin II, human transferrin receptor, or EpCAM.

In an embodiment, one or more polynucleotides are inserted into a gene locus of the viral genome, or inserted between two gene loci of the viral genome. In an embodiment, the viral gene loci are selected from the group consisting of the internal repeat joint region (comprising one copy each of the diploid genes ICP0, ICP34.5, LAT, ICP4, and the ICP47 promoter), ICP0, LAT, UL1, UL5, UL6, UL7, UL8, UL9, UL11, UL12, UL14, UL15, UL17, UL18, UL19, UL20, UL22, UL25, UL26, UL26.5, UL27, UL28, UL29, UL30, UL31, UL32, UL33, UL34, UL35, UL36, UL37, UL38, UL39, UL40, UL42, UL48, UL49, UL52, UL53, UL54, ICP0, ICP4, ICP22, ICP27, ICP47, gamma-34.5, US3, US4, US5, US6, US7, US8, US9, US10, US11, and US12.

In an embodiment, the present disclosure provides a nucleic acid molecule encoding an oncolytic virus described herein. In an embodiment, the present disclosure provides a viral stock comprising an oncolytic virus described herein. In an embodiment, the present disclosure provides a composition comprising an oncolytic virus described herein and a pharmaceutically-acceptable carrier.

In an embodiment, the present disclosure provides a method of killing a cancerous cell, comprising exposing the cancerous cell to an oncolytic virus described herein or compositions thereof under conditions sufficient for the oncolytic virus to infect and replicate within said cancerous cell, and wherein replication of the oncolytic virus within the cancerous cell results in cell death. In an embodiment, the cancerous cell has a reduced expression of a miR capable of binding to the one or more miR-target sequences compared to the expression of the miR in a non-cancerous cell. In an embodiment, the expression level of the miR in the cancerous cell is at least 5% less than the expression level the miR in the non-cancerous cell. In an embodiment, replication of the oncolytic virus is increased or maintained in cancerous cells with a reduced expression of the miR capable of binding to the one or more miR-target sequences. In an embodiment, the viral replication is at least 5% greater in the cancerous cells compared to the viral replication in the non-cancerous cell. In an embodiment, the cell is in vivo. In an embodiment, the cell is within a tumor.

In an embodiment, the present disclosure provides a method of treating cancer in a subject in need thereof, comprising administering an oncolytic virus described herein or compositions thereof to a subject in need thereof. In an embodiment, the subject is a mouse, a rat, a rabbit, a cat, a dog, a horse, a non-human primate, or a human. In an embodiment, the oncolytic virus or compositions thereof are administered intravenously, subcutaneously, intratumorally, intramuscularly, or intranasally. In an embodiment, the cancer is selected from lung cancer, breast cancer, ovarian cancer, cervical cancer, prostate cancer, testicular cancer, colorectal cancer, colon cancer, pancreatic cancer, liver cancer, gastric cancer, head and neck cancer, thyroid cancer, malignant glioma, glioblastoma, melanoma, B-cell chronic lymphocytic leukemia, diffuse large B-cell lymphoma (DLBCL), and marginal zone lymphoma (MZL). In an embodiment, the lung cancer is small cell lung cancer or non-small cell lung cancer. In an embodiment, the liver cancer is hepatocellular carcinoma (HCC).

In an embodiment, a recombinant oncolytic virus described herein further comprises a payload molecule, wherein the payload molecule or protein is an anti-FAP/anti-CD3 bispecific T cell engager. In an embodiment, a recombinant oncolytic virus described herein further comprises a payload molecule, wherein the payload molecule or protein is an anti-PD1-Fc-41BBL protein.

BRIEF DESCRIPTION OF THE DRAWINGS

FIG. 10A shows a schematic of a pTetR tet repressor plasmid that induces expression of an miRNA expression plasmid. FIG. 10B shows a schematic of a pTF-002 miRNA expression plasmid containing a tet-inducible mCherry and miRNA expression cassette. FIG. 10C shows a schematic of a pTF-004 miRNA attenuation reporter enabling the read-out of destabilized GFP (dsGFP).

FIG. 24 shows quantitation of miR-127 and miR-451-attenuated GFP fluorescence.

FIG. 25 shows quantitation of miR-133 and miR-451-attenuated GFP fluorescence.

FIG. 26 shows quantitation of miR-223 and miR-451-attenuated GFP fluorescence.

FIG. 27A shows fluorescence-based quantitation of HSV attenuation in post-mitotic lung cells. FIG. 27B shows fluorescence-based quantitation of HSV attenuation in A253 cells. FIG. 27C shows qPCR-based quantitation of HSV attenuation in post-mitotic lung cells. FIG. 27D shows qPCR-based quantitation of HSV attenuation in A253 cells.

FIG. 30A-FIG. 30C illustrate miRNA-125a (FIG. 30A) and miRNA-122 (FIG. 30B) expression and effect on viral replication (FIG. 30C) in A253, Huh7, and Hep3B cell lines.

FIG. 31 shows a Western blot illustrating reduced viral spread and protein expression after infection with miR-T122 and/or miR-T125a containing HSV in cells expressing miR-122 and miR-125a.

FIG. 32A-FIG. 32B shows increased intracellular expression of miR-125a and mir-122 after transfection with a miR-125a mimic (FIG. 32A) or a miR-122 mimic (FIG. 32B). FIG. 32C shows attenuation of replication of oncolytic HSV vectors with cognate miR target sequences at distinct genetic loci shown by fluorescence images and quantification of GFP fluorescence (FIG. 32D).

CRISPR associated endonuclease (e.g. SpCas9, SaCas9, FnCpf1, FnCas9, etc.); Poly(A): polyadenylation signal (e.g. bGH); gRNA: Single crRNA-trRNA fusion (DR-crRNA-DR-trRNA); crRNA targeted to oncogenic microRNA (e.g. miR-17, miR-21, miR-155); Pol III promoter: E.g. U6, H1, 7SK.

Figure 40:
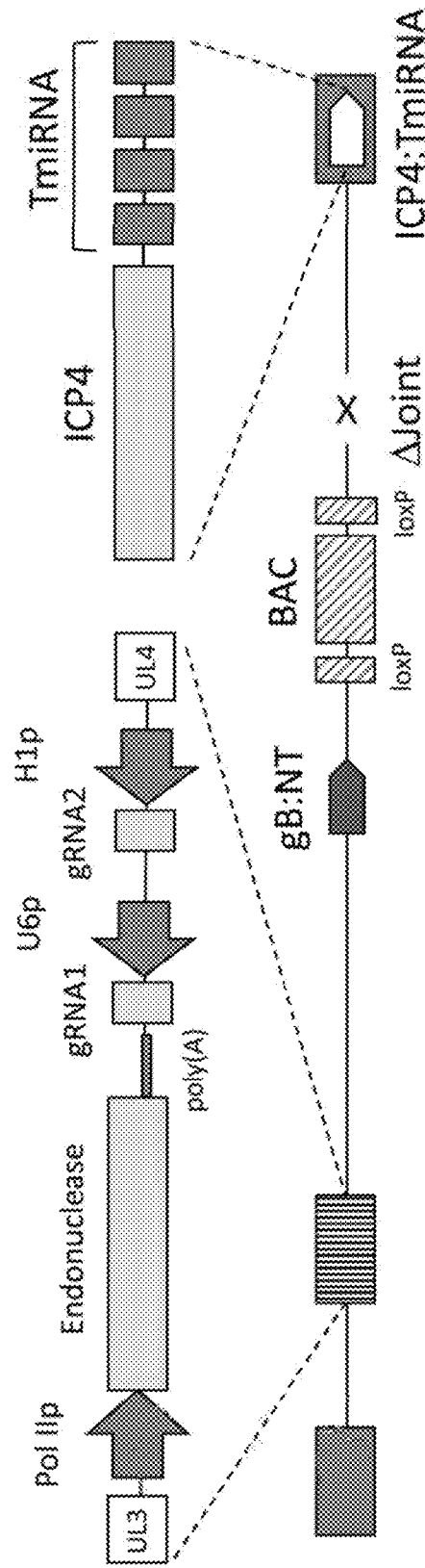

FIG. 40 shows a schematic of an ICP4-TmiRNA-attenuated, genome-editing, microenvironment-remodeling HSV vector for the treatment of cancer. gB:NT: virus entry-enhancing double mutation in gB gene; BAC: loxP-flanked choramphenicol-resistance and lacZ sequences; Δjoint: deletion of the complete internal repeat region including one copy of the ICP4 gene; ICP4:TmiRNA: insertion of miRNA target sequences (e.g. let-7, miR-34a, miR-101, miR-125b, miR-145) into the 3' UTR of the remaining ICP4 gene (also may be placed in 5' UTR); Pol II promoter: Constitutive (CAG, UbC, EF1a, PGK) or cell-specific (e.g. TRPV1, Nav1.7, hSYN); Endonuclease: CRISPR associated endonuclease (e.g. SpCas9, SaCas9, FnCpf1, FnCas9, etc.); Poly(A): polyadenylation signal (e.g. bGH); gRNA2: crRNA targeted to microenvironment remodeling miRNA (e.g. miR-143, miR-218) or TIMP (e.g. TIMP1, TIMP2); Pol III promoter: E.g. U6, H1, 7SK.

Figure 41:
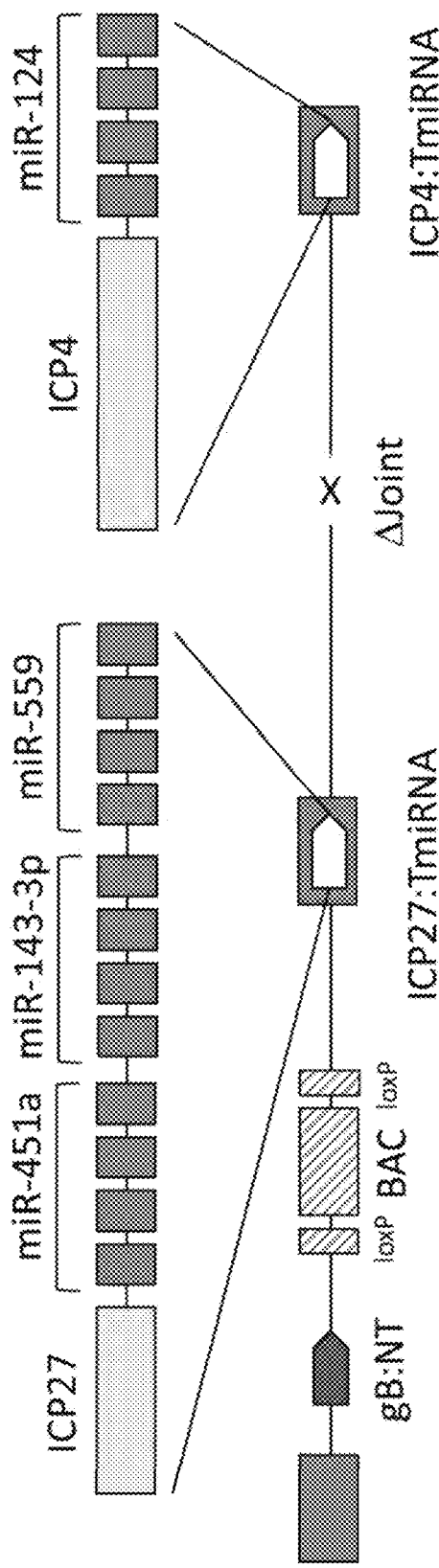

FIG. 41 shows a schematic of an ICP4-TmiRNA and ICP27-TmiRNA-attenuated HSV vector for the treatment of pancreatic, lung, and colon cancer. gB:NT: virus entry-enhancing double mutation in gB gene; BAC: loxP-flanked choramphenicol-resistance and lacZ sequences; Δjoint: deletion of the complete internal repeat region including one copy of the ICP4 gene; ICP4:TmiRNA: insertion of miR-124 target sequence cassette into the 3' UTR of the remaining ICP4 gene (also may be placed in 5' UTR); ICP27: TmiRNA: insertion of miR-451a, miR-143-3p, and miR-559 target sequence cassettes into the 3' UTR of the ICP-27 gene (also may be placed in 5' UTR).

Figure 42:
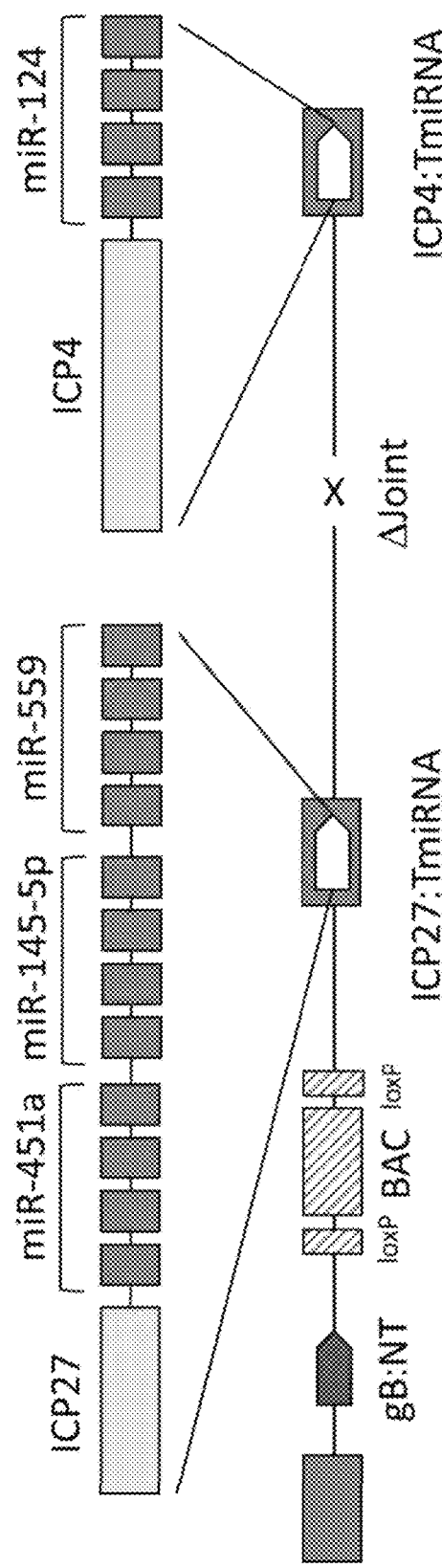

FIG. 42 shows a schematic of an ICP4-TmiRNA and ICP27-TmiRNA-attenuated HSV vector for the treatment of multiple cancer types. gB:NT: virus entry-enhancing double mutation in gB gene; BAC: loxP-flanked choramphenicol-resistance and lacZ sequences; Δjoint: deletion of the complete internal repeat region including one copy of the ICP4 gene; ICP4:TmiRNA: insertion of miR-124 target sequence cassette into the 3' UTR of the remaining ICP4 gene (also may be placed in 5' UTR); ICP27:TmiRNA: insertion of miR-451a, miR-145-5p, and miR-559 target sequence cassettes into the 3' UTR of the ICP-27 gene (also may be placed in 5' UTR).

Figure 43:
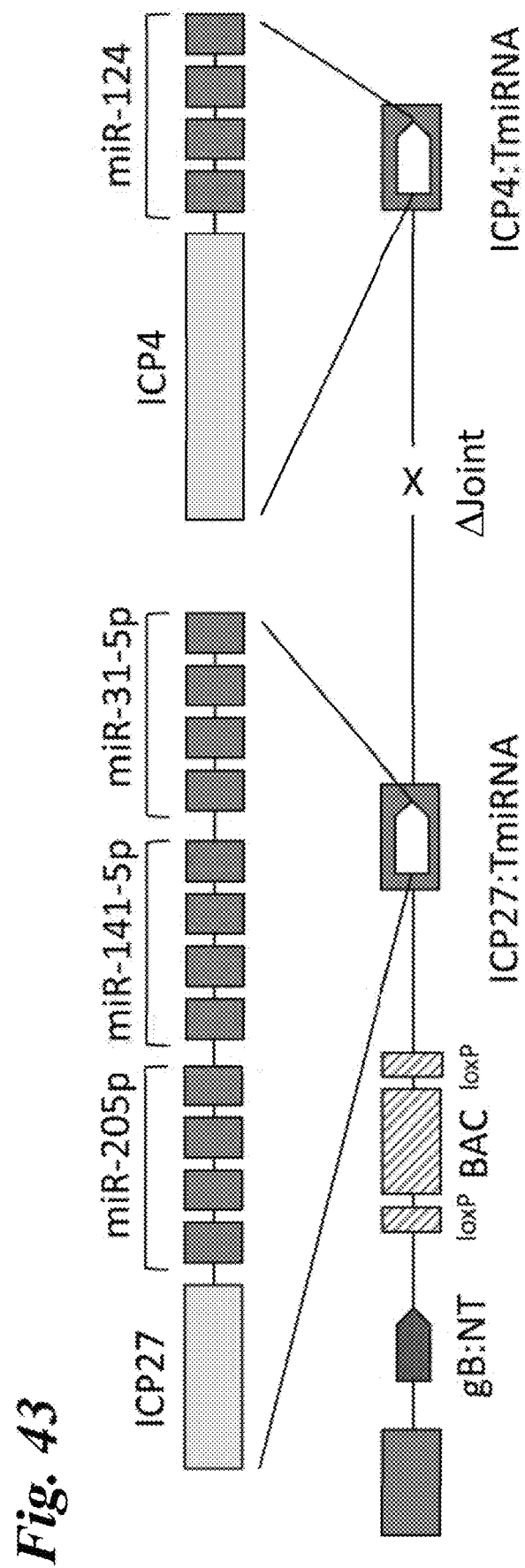

FIG. 43 shows a schematic of an ICP4-TmiRNA and ICP27-TmiRNA-attenuated HSV vector for the treatment of schwannoma. gB:NT: virus entry-enhancing double mutation in gB gene; BAC: loxP-flanked choramphenicol-resistance and lacZ sequences; Δjoint: deletion of the complete internal repeat region including one copy of the ICP4 gene; ICP4:TmiRNA: insertion of miR-124 target sequence cassette into the 3' UTR of the remaining ICP4 gene (also may be placed in 5' UTR); ICP27:TmiRNA: insertion of miR-205p, miR-141-5p, and miR-31-5p target sequence cassettes into the 3' UTR of the ICP-27 gene (also may be placed in 5' UTR).

Figure 44:
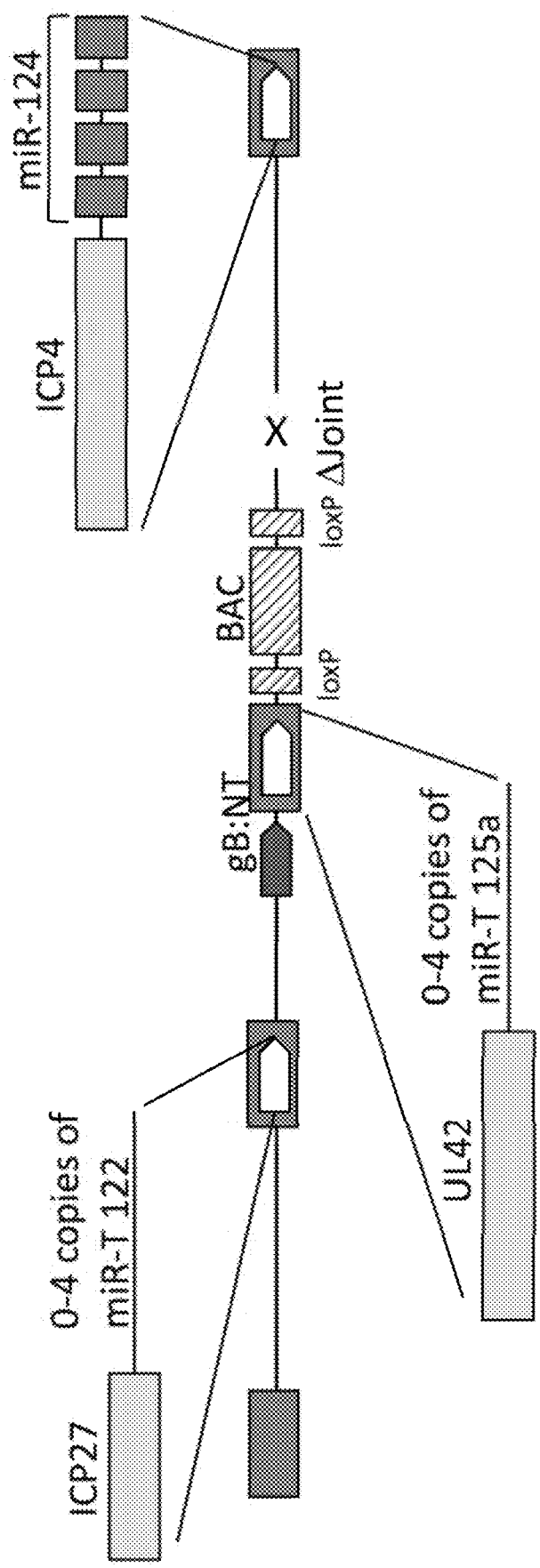

FIG. 44 shows a schematic of a miR-attenuated HSV virus, wherein multiple copies of miR-122, miR-125a, and/or miR-124 target sites are inserted into ICP27, UL42 and/or ICP4.

Figure 45:
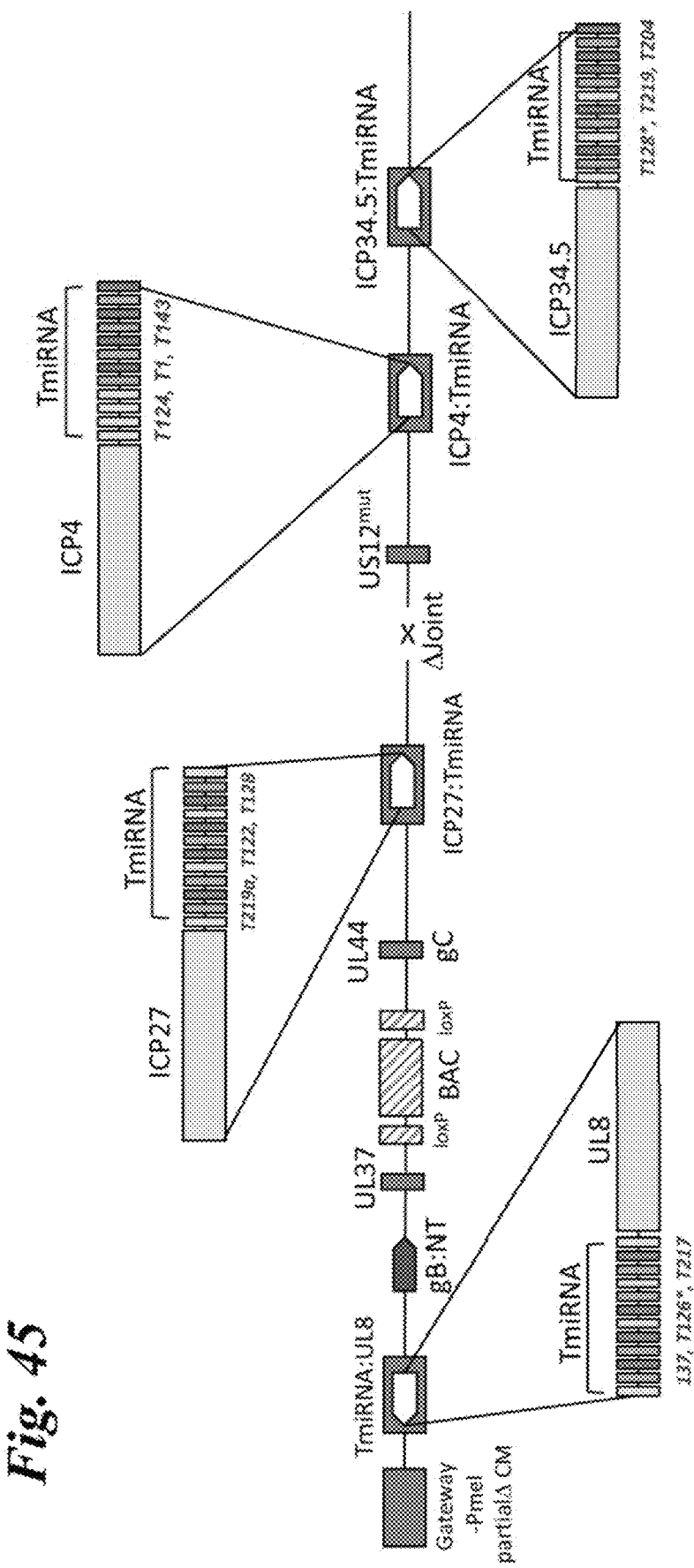

FIG. 45 shows a schematic of a miR-attenuated HSV virus (ONCR-157), wherein miR target site cassettes are inserted into UL8, ICP12, ICP4, and ICP34.5

Figure 46:
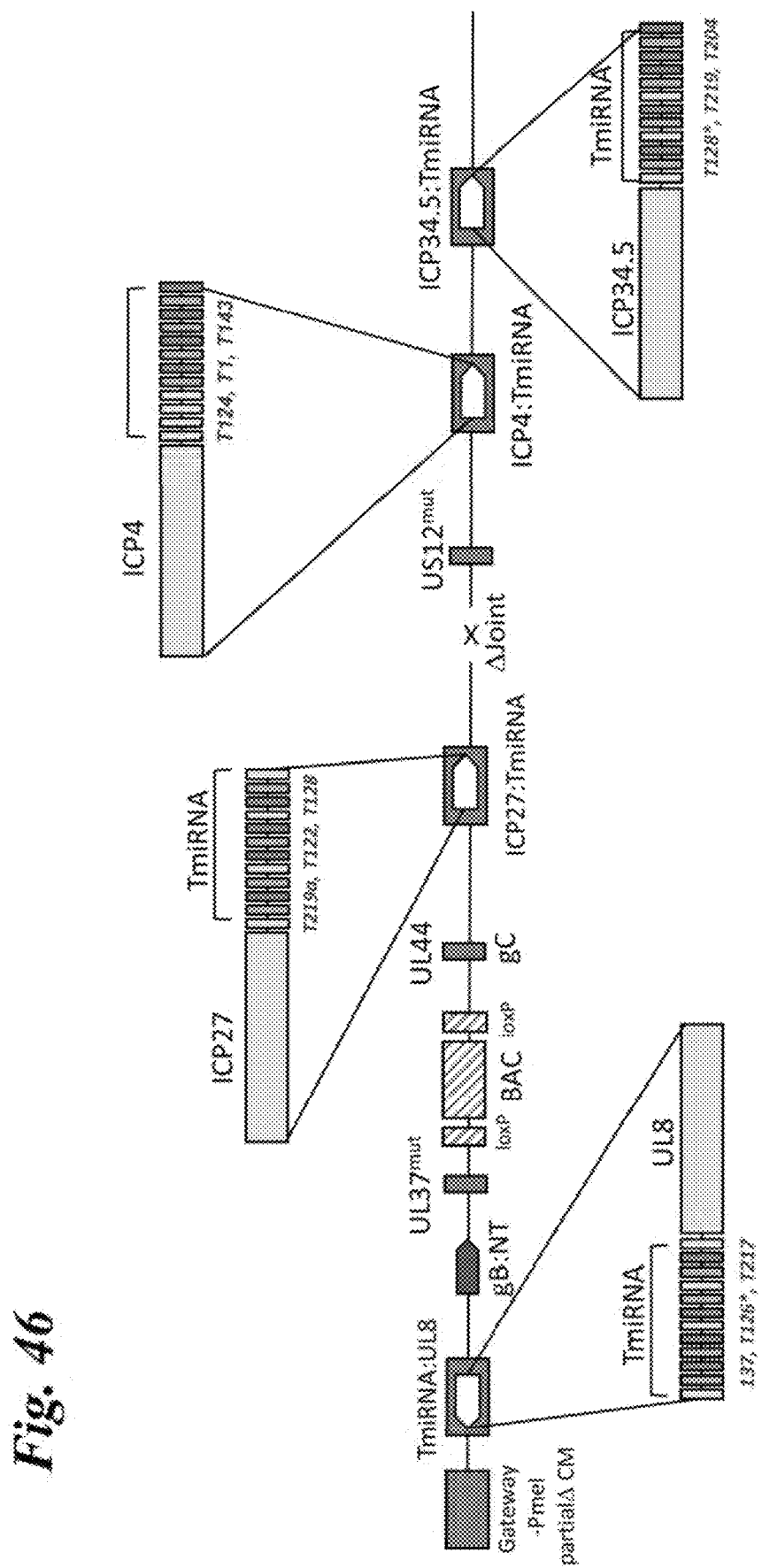

FIG. 46 shows a schematic of a miR-attenuated HSV virus (ONCR-159), wherein miR target site cassettes are inserted into UL8, ICP12, ICP4, and ICP34.5.

FIG. 47A shows GFP intensity generated by a reporter virus engineered to expression GFP in cells treated with pooled siRNAs against various viral genes. FIG. 47B shows results in the same assay for individual siRNAs.

Figure 48A:
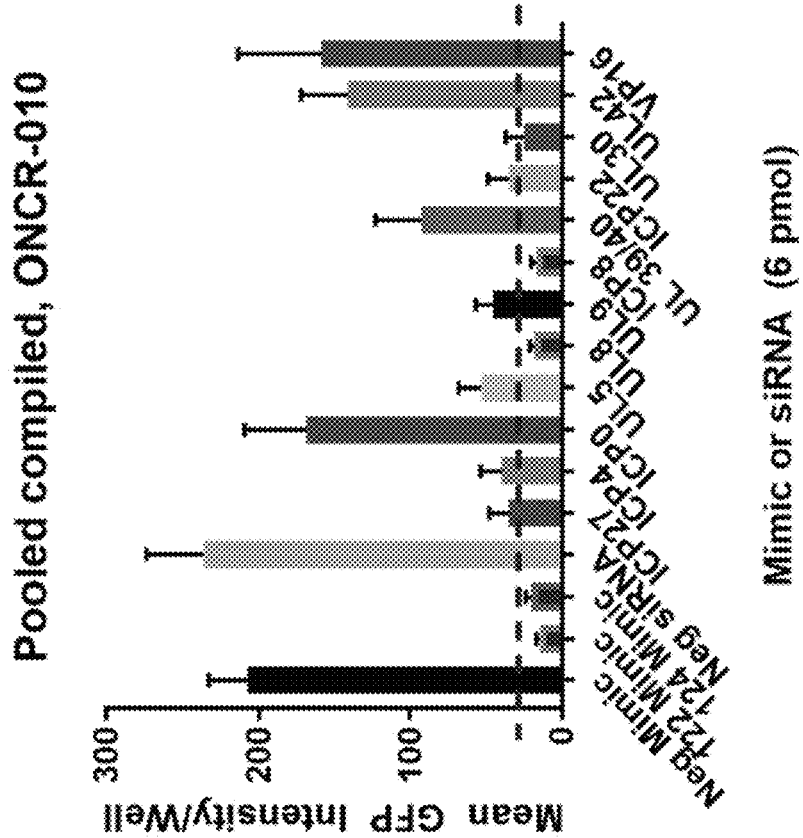
Figure 48B:
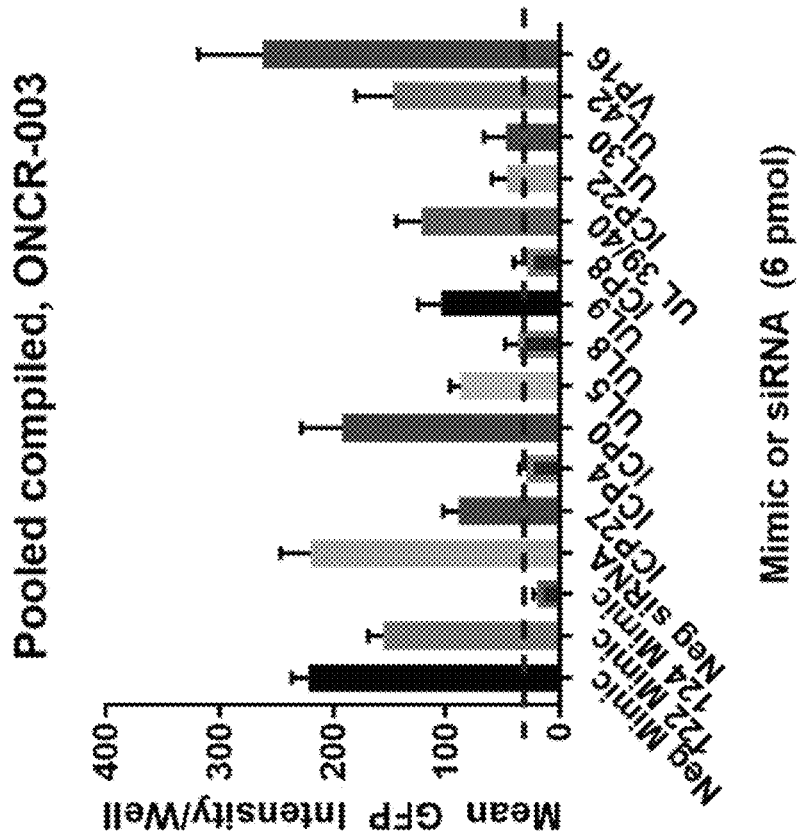

FIGS. 48A and 48B shows GFP intensity generated by a reporter virus engineered to expression GFP in cells treated with pooled siRNAs against various viral genes using the HSV vector ONCR-003 (left) or ONCR-010 (right).

Figure 49:
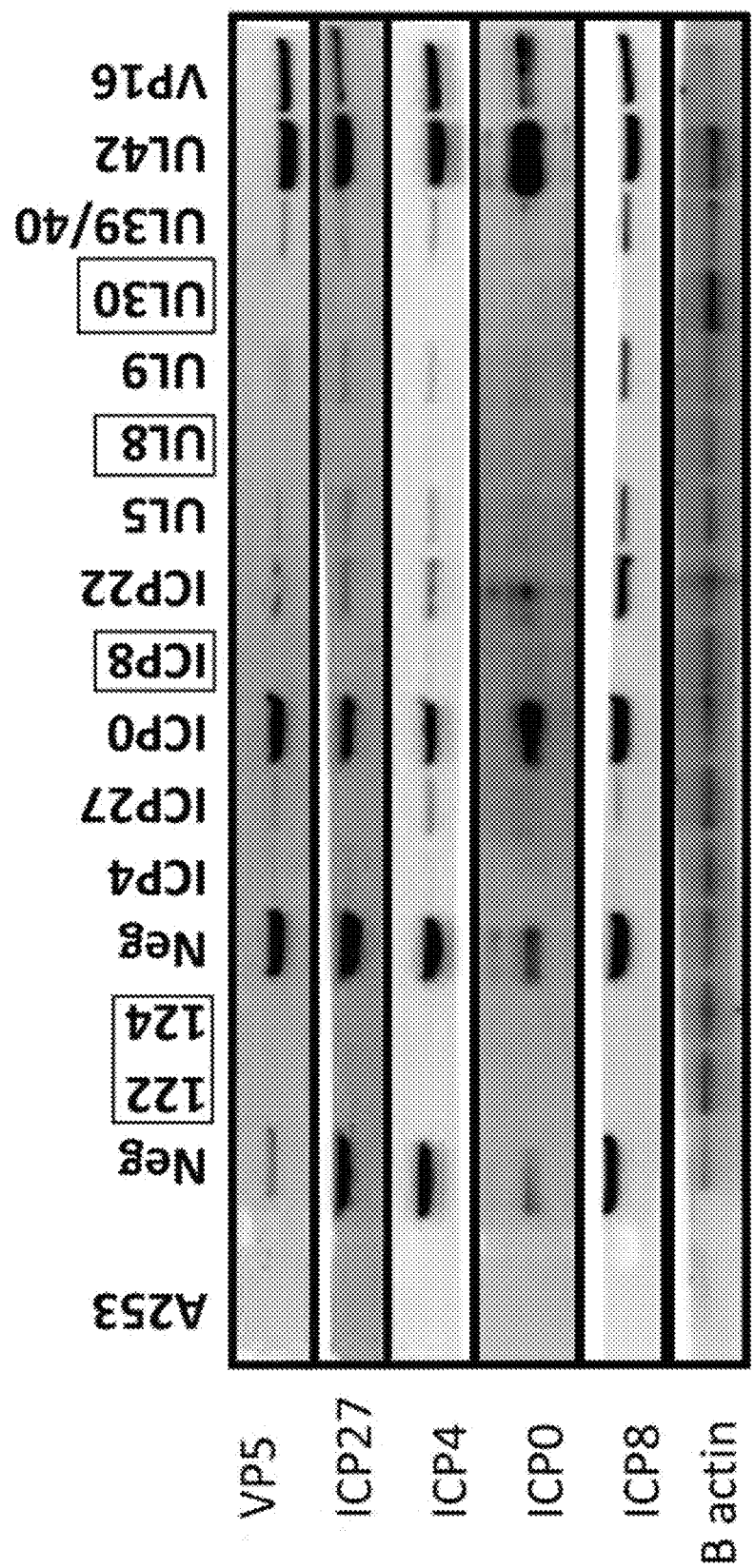

FIG. 49 shows a Western blot to detect expression of viral proteins in cells infected with HSV vector and treated with siRNA against viral genes as indicated. Beta-actin is a positive control for the Western blot.

FIGS. 50A and 50B show Nanostring assay data for normal brain tissue compared to malignant tissue as ratio of miRNA expression (FIG. 50A) and normalized counts (FIG. 50B).

Figure 51B:
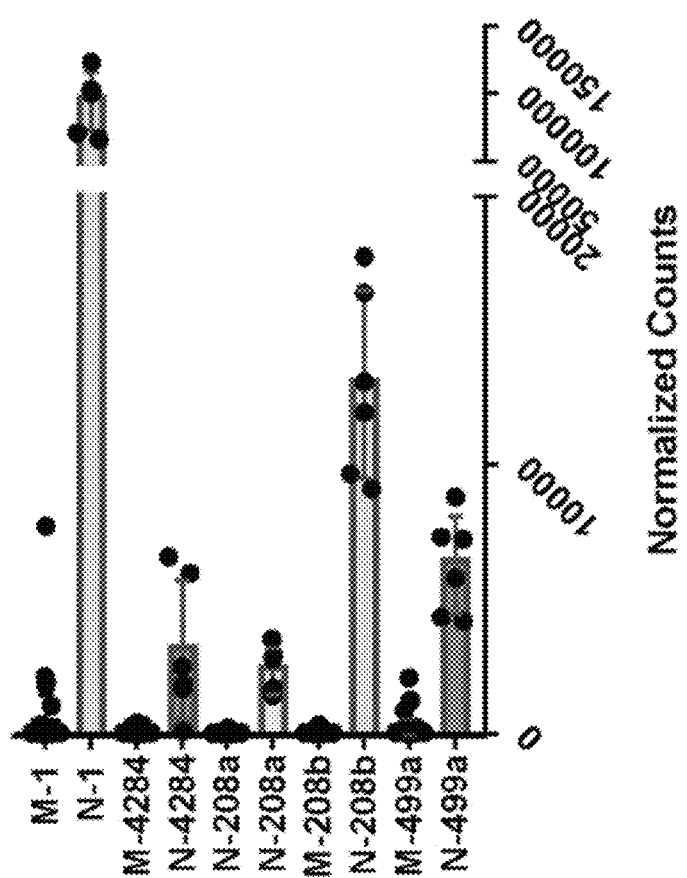
Figure 51A:
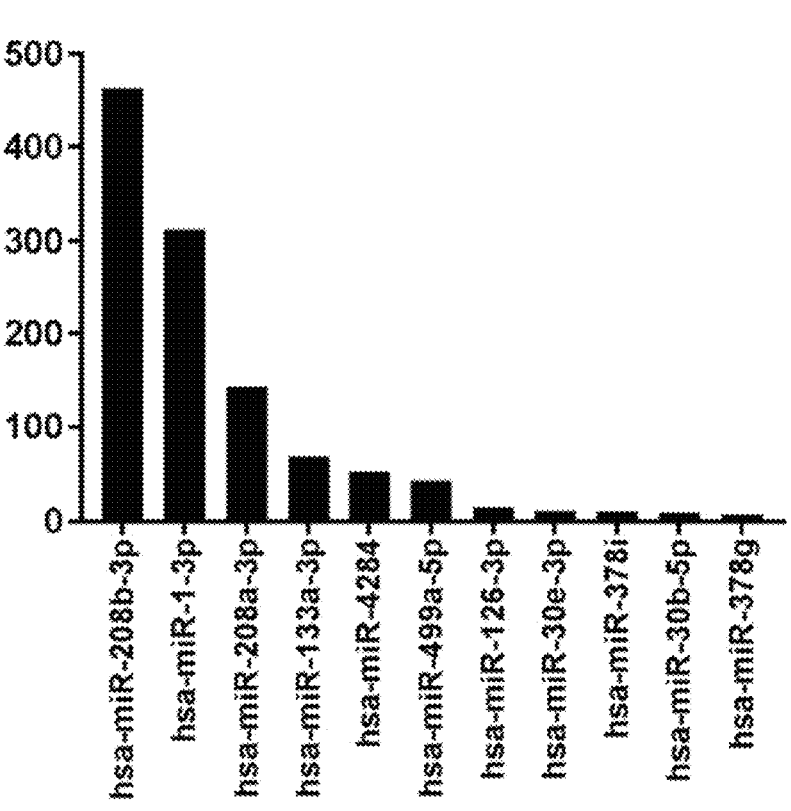

FIGS. 51A and 51B show Nanostring assay data for normal heart tissue compared to malignant tissue as ratio of miRNA expression (FIG. 51A) and normalized counts (FIG. 51B).

Figure 52B:
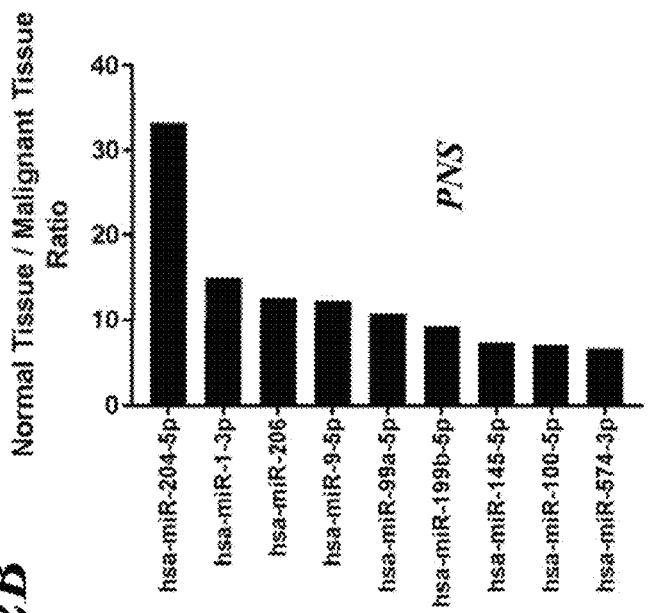
Figure 52A:
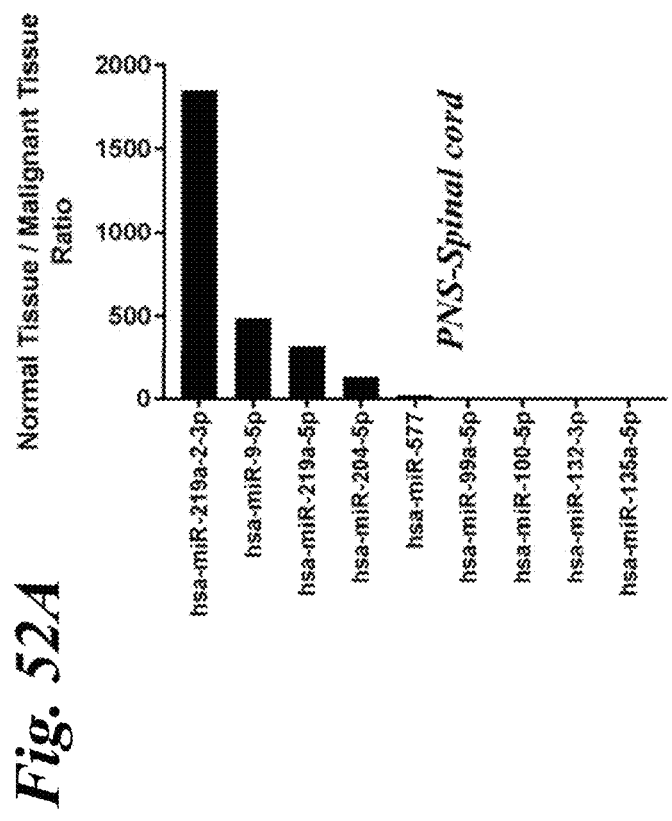
Figure 52C:
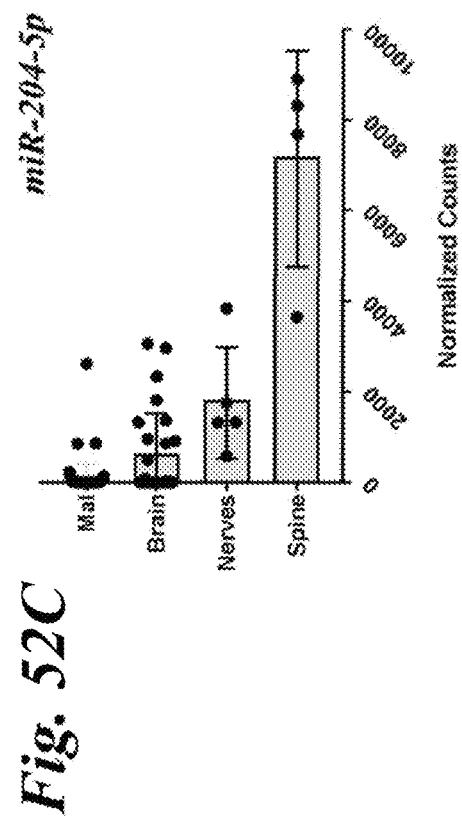

FIG. 52A shows Nanostring assay data for normal spinal-cord tissue compared to malignant tissue as ratio of miRNA expression. FIGS. 52A and 52B show Nanostring assay data for normal nerve or ganglion tissue compared to malignant tissue as ratio of miRNA expression (FIG. 52A) and normalized counts (FIG. 52C).

Figure 53A:
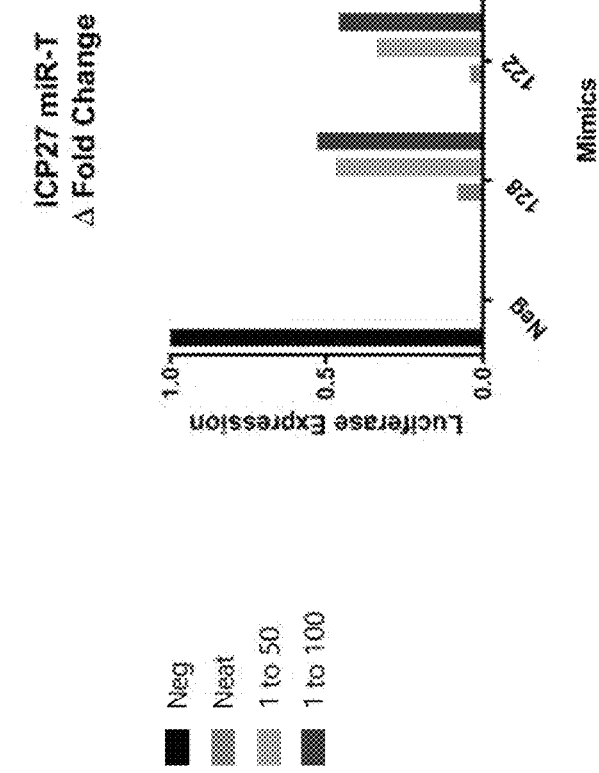
Figure 53B:
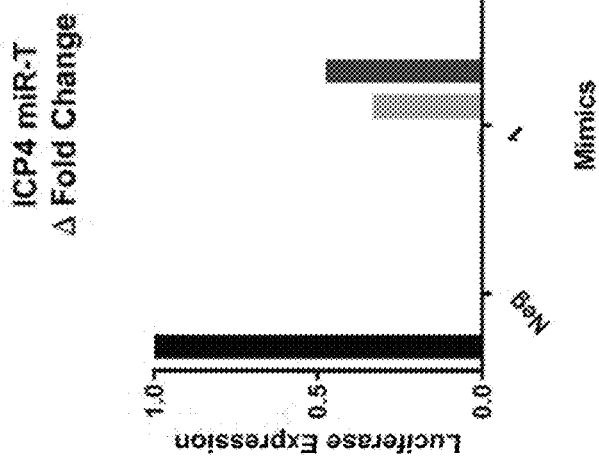

FIGS. 53A and 53B show luciferase assay testing of miR-TS cassettes for cassette 1 (FIG. 53A) or cassette 2 (FIG. 53B)

Figure 54A:
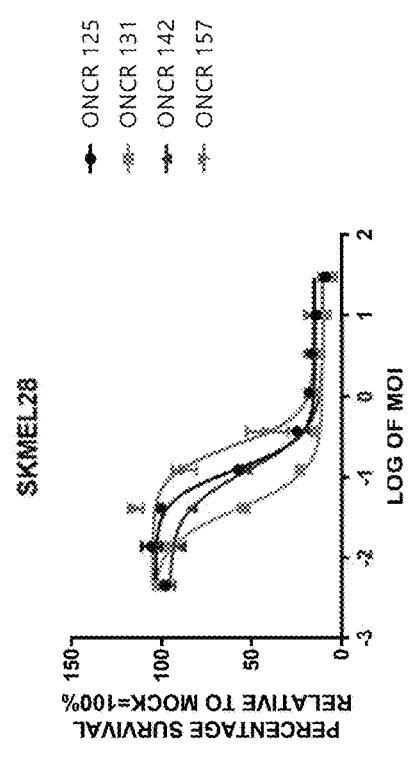
Figure 54B:
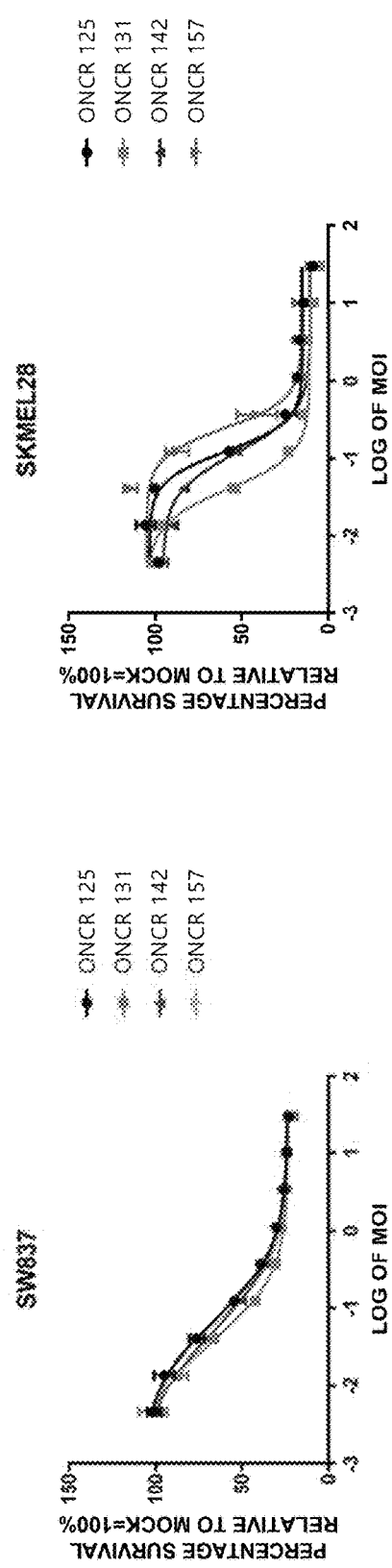
Figure 54D:
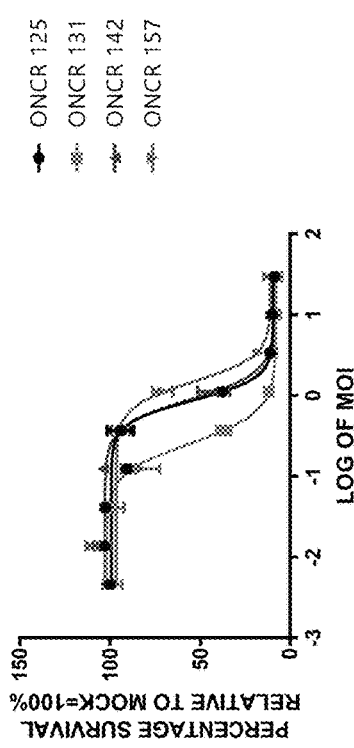
Figure 54C:
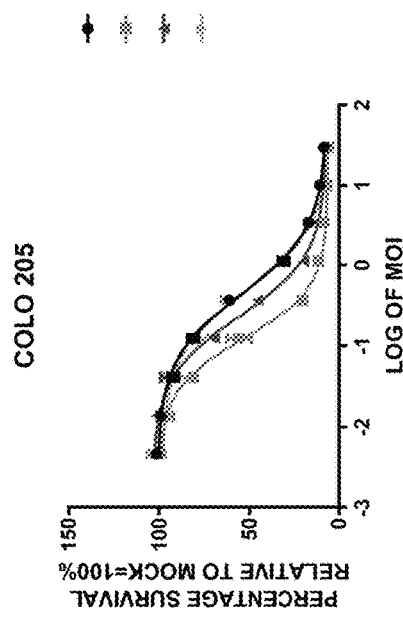
Figure 54E:
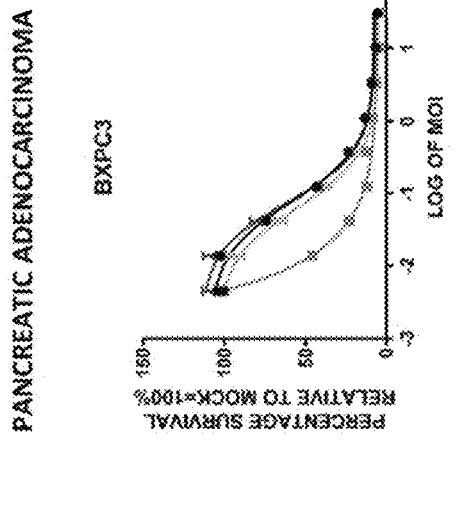
Figure 54F:
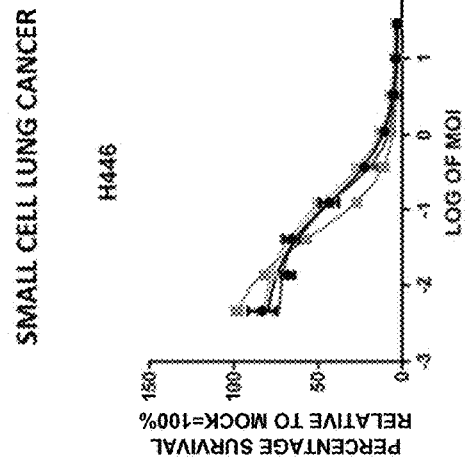
Figure 54G:
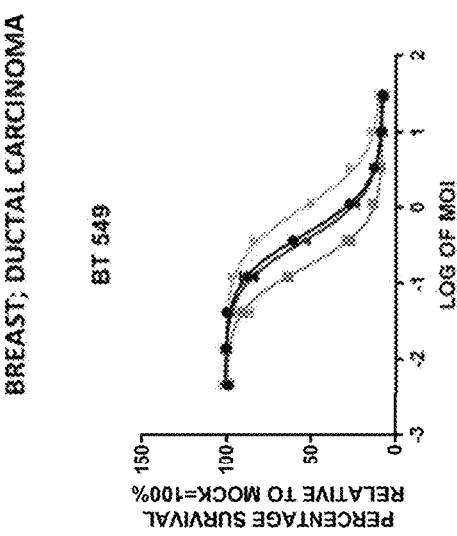

FIG. 54A-FIG. 54G show cytotoxicity of oncolytic HSV viral vectors ONCR-125, ONCR-131, ONCR-142, and ONCR-157 in cancer cell lies SW837 (FIG. 54A), SKMEL28 (FIG. 54B), COLO 205 (FIG. 54C), A375 (FIG. 54D), H446 (FIG. 54E), BXPC3 (FIG. 54F), and BT549 (FIG. 54G).

Figure 55:
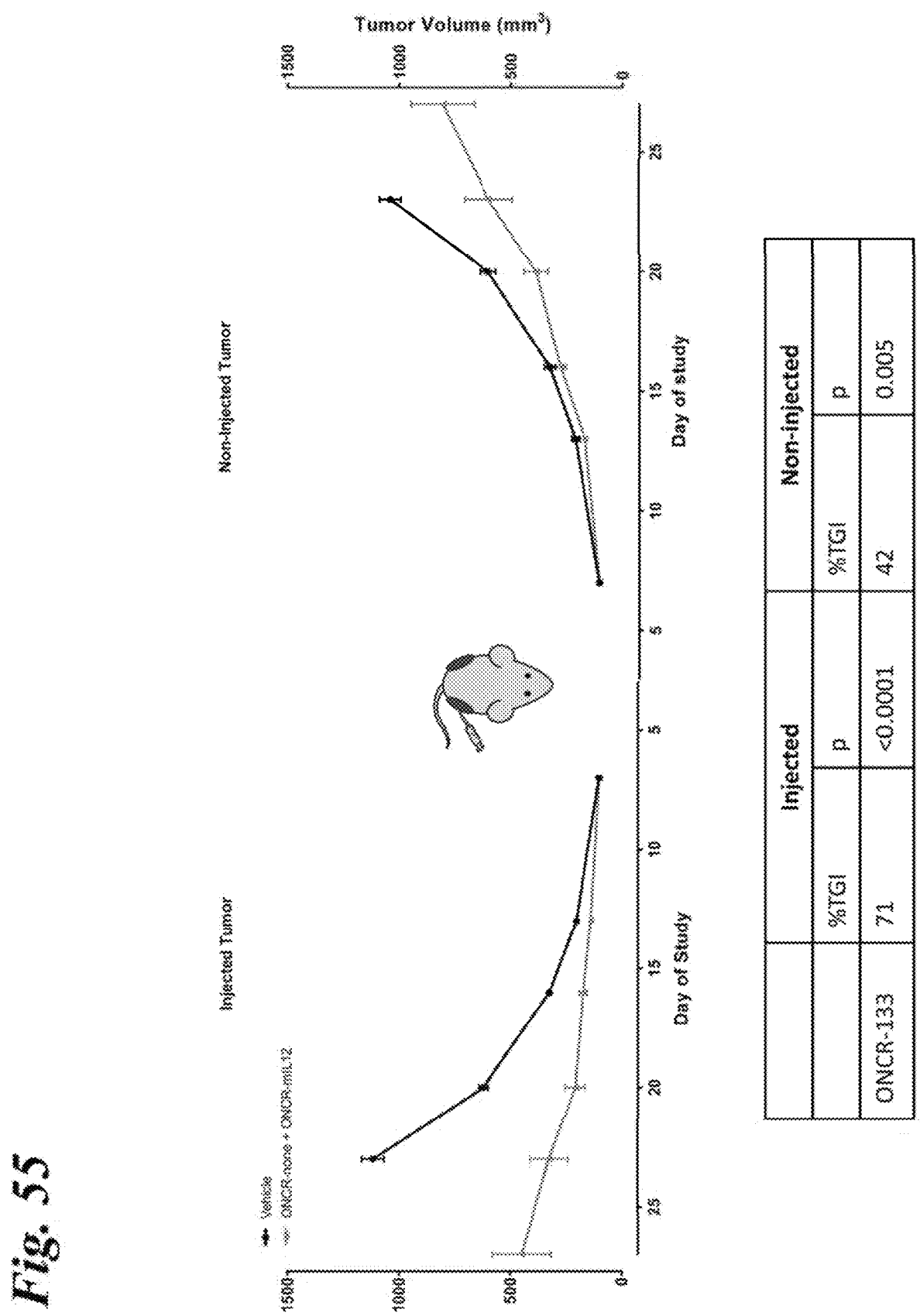

FIG. 55 shows tumor growth inhibitor effect of vehicle compared to virus (as indicated in legend) in a mouse xenograph experiment. The increase in tumor volume of the injected tumor is compared to the increase in tumor volume of the non-injected tumor. ONCR-133 significantly inhibited tumor growth of injected tumors compared to vehicle treated controls (p<0.0001). ONCR-133 treatment also significantly inhibited tumor growth of non-injected tumors (p<0.005), indicating an enhanced abscopal effect.

Figure 56:
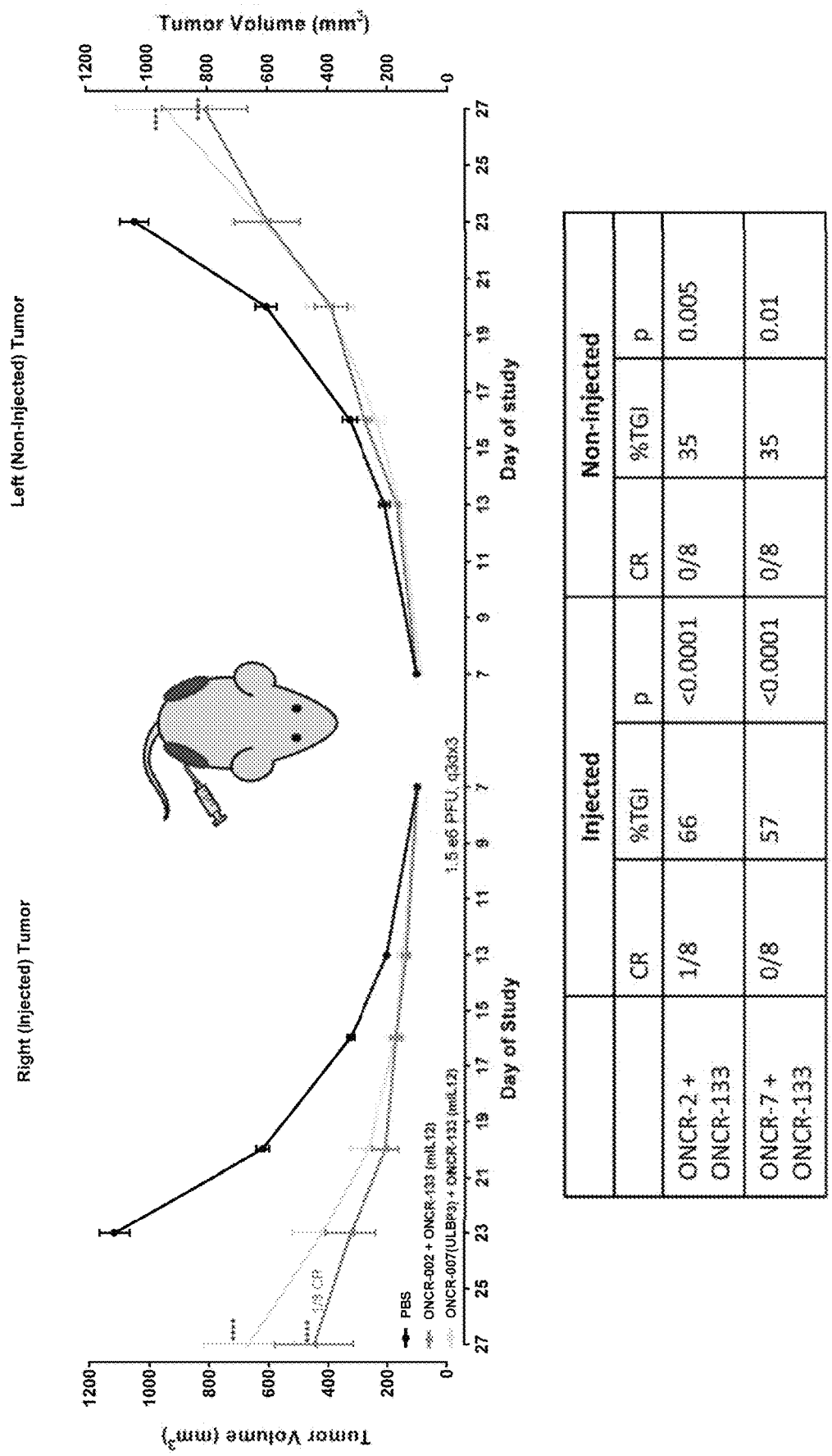

FIG. 56 shows tumor growth inhibitor effect of vehicle compared to virus (as indicated in legend) in a mouse xenograph experiment. The increase in tumor volume of the injected tumor is compared to the increase in tumor volume of the non-injected tumor. Mice treated with ONCR-133+ONCR-007 (an HSV construct expressing ULBP3) or ONCR-133+ONCR-002 (an HSV construct that does not express any additional payload molecules) both demonstrated a significant inhibition of tumor growth compared to vehicle treated controls.

Figure 57:
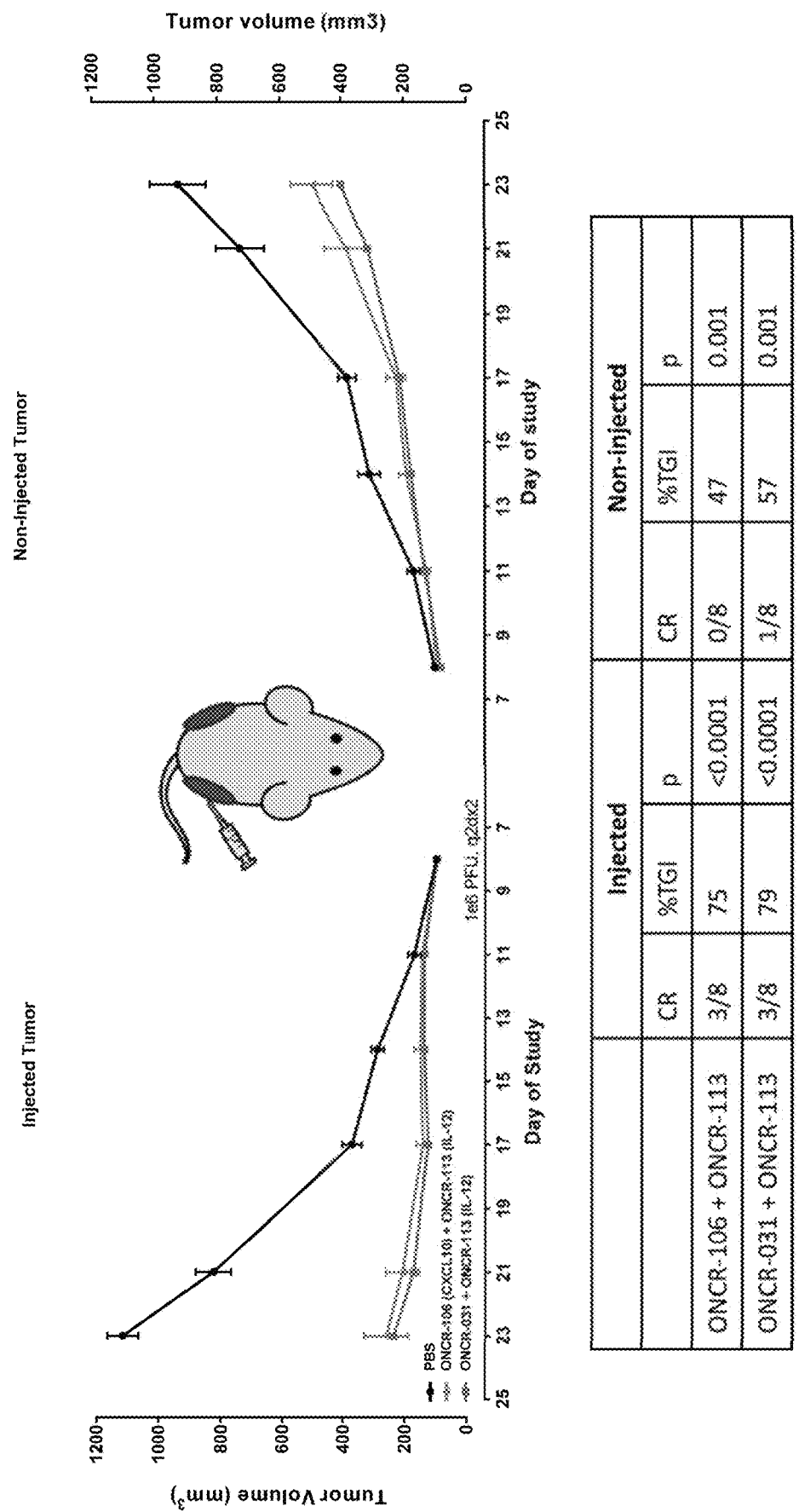

FIG. 57 shows tumor growth inhibitor effect of vehicle compared to virus (as indicated in legend) in a mouse xenograph experiment. The increase in tumor volume of the injected tumor is compared to the increase in tumor volume of the non-injected tumor. The additional expression of CXCL10 in the ONCR-106+ONCR-113 treated group did not enhance the inhibition of tumor growth in either injected or non-injected tumors compared to mice treated with ONCR-031+ONCR-113.

Figure 58:
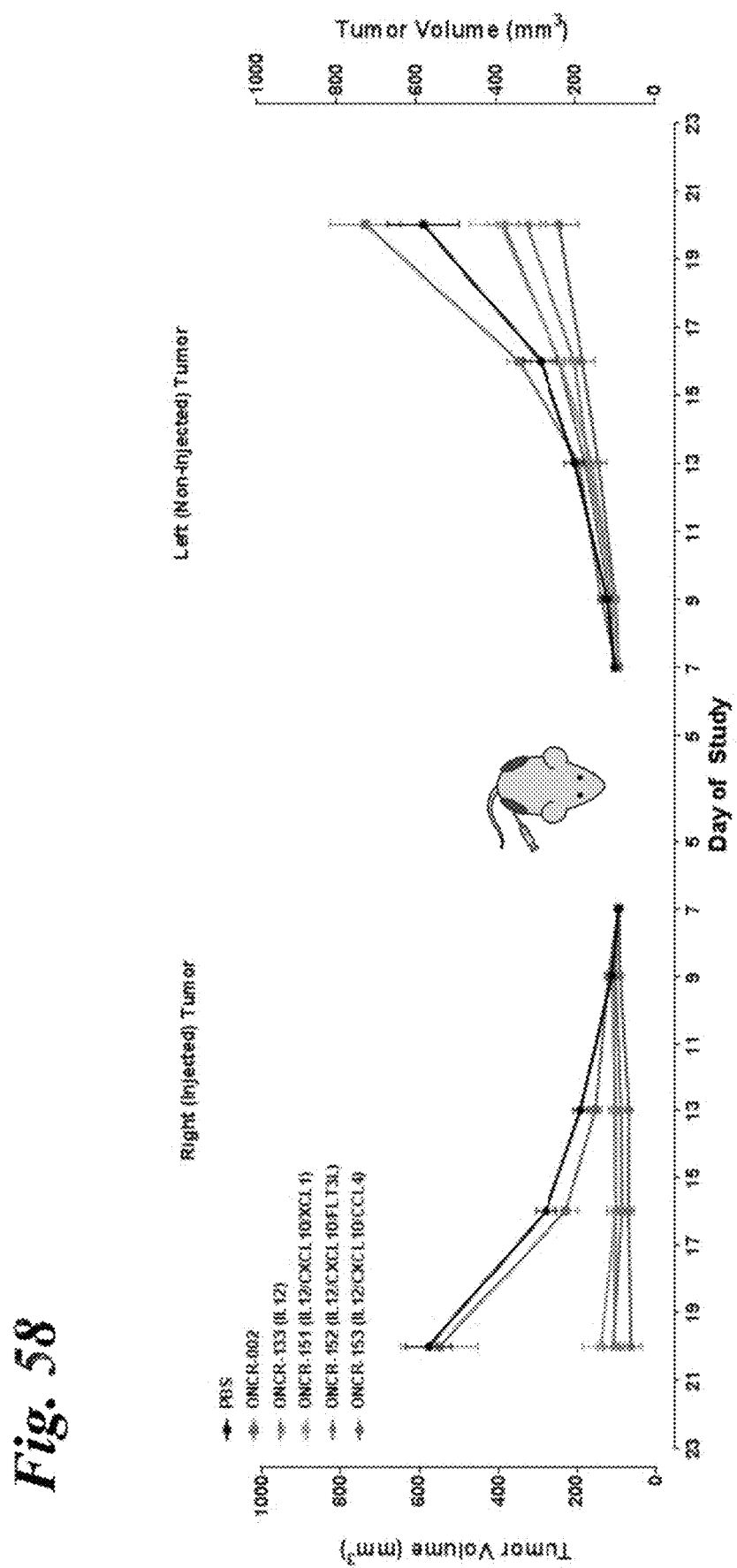

FIG. 58 shows tumor growth inhibitor effect of vehicle compared to virus (as indicated in legend) in a mouse xenograph experiment. The increase in tumor volume of the injected tumor is compared to the increase in tumor volume of the non-injected tumor. the additional expression of CXCL10 in the ONCR-106+ONCR-113 treated group did not enhance the inhibition of tumor growth in either injected or non-injected tumors compared to mice treated with ONCR-031+ONCR-113.

Figure 59B:
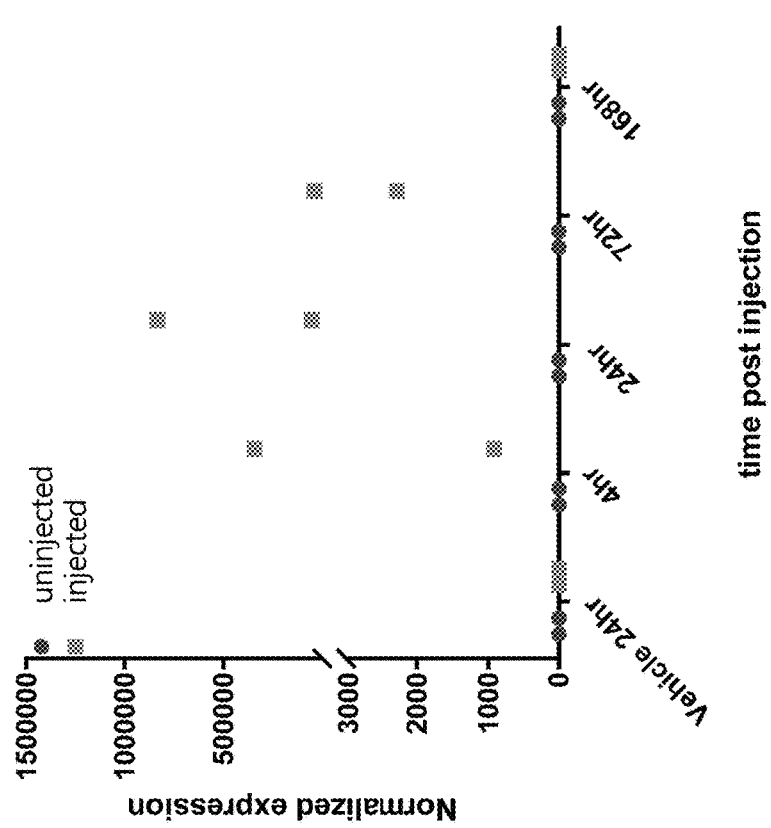
Figure 59A:
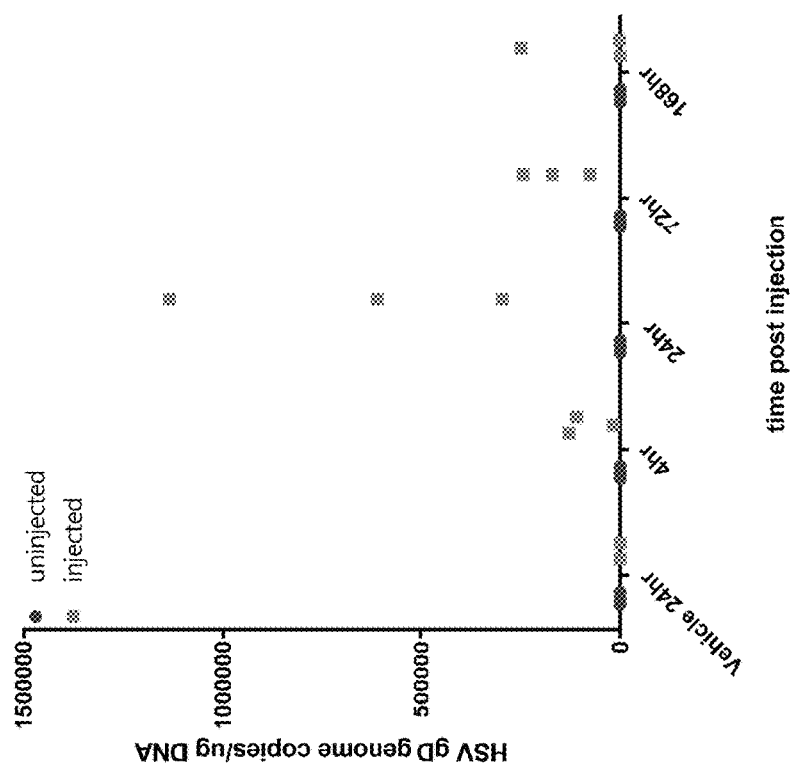

FIG. 59A-FIG. 59B show replication of injected virus occurs only in the injected tumor, not in the non-injected tumor, suggesting that the anti-tumor effect observed in the non-injected tumor is immune-mediated. Data is ploted as raw genome copies per microgram DNA (FIG. 59A) or as normalized expression (FIG. 59B). HSV was detected in the injected tumors, but not in the non-injected tumors, indicating that the tumor growth inhibition observed in the non-injected tumors was not due to viral spread, but rather the abscopal effects of virus administration.

Figure 60A:
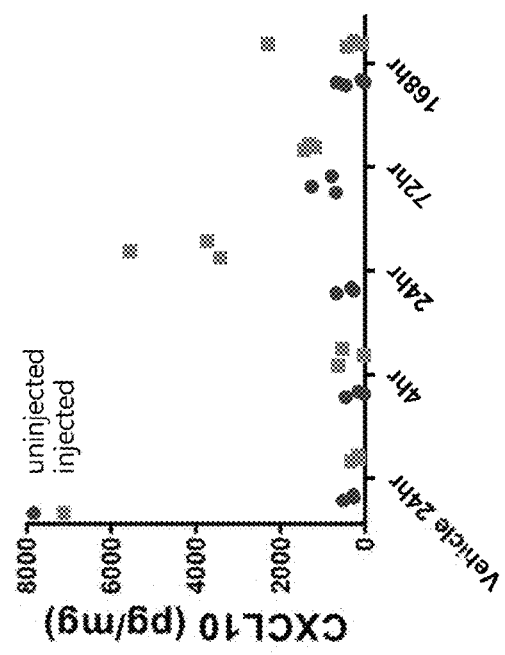
Figure 60B:
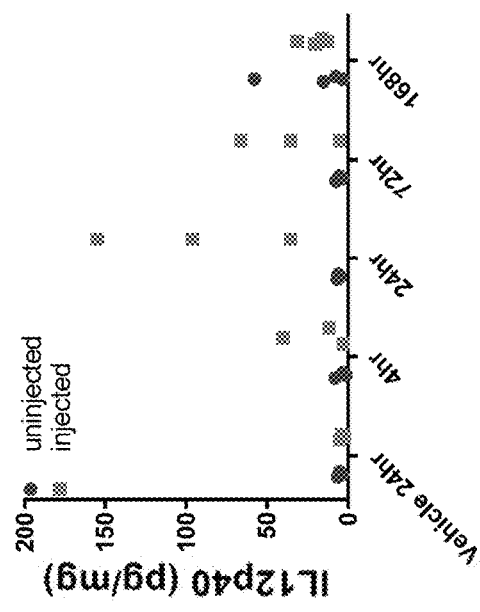
Figure 60C:
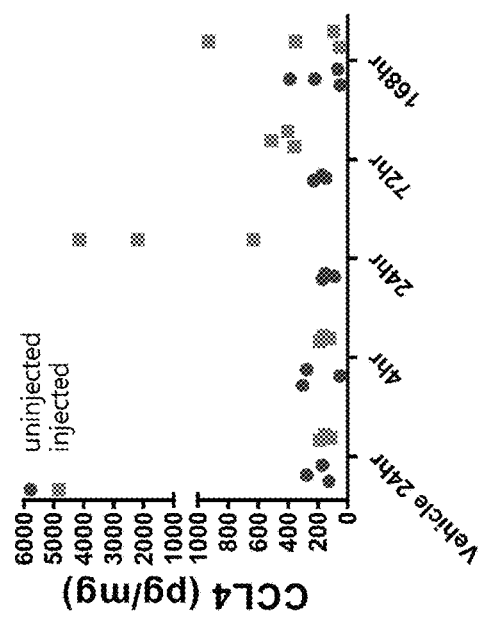

FIG. 60A-FIG. 60C show payload expression peaked in the injected tumors at 24-hours post-treatment and decreased thereafter.

FIG. 61A-FIG. 61C shows levels of the payloads in the serum of mice treated with ONCR-153, where only CXCL10 expression was observed.

Figure 62B:
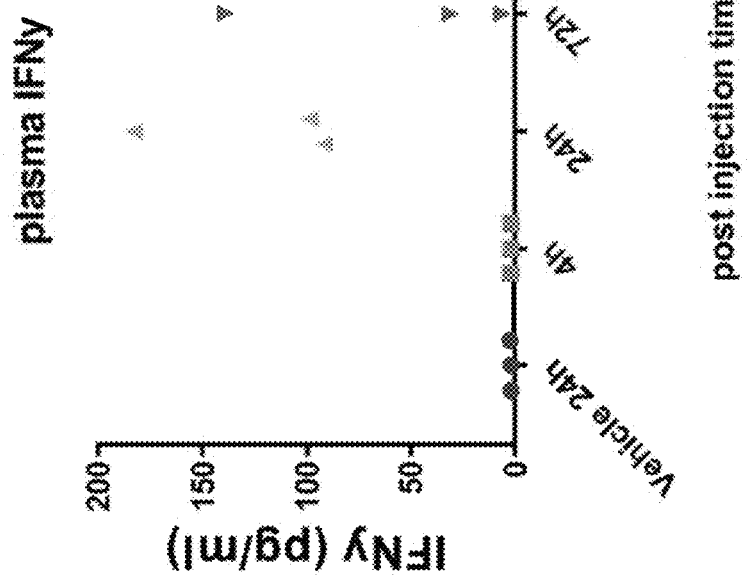
Figure 62A:
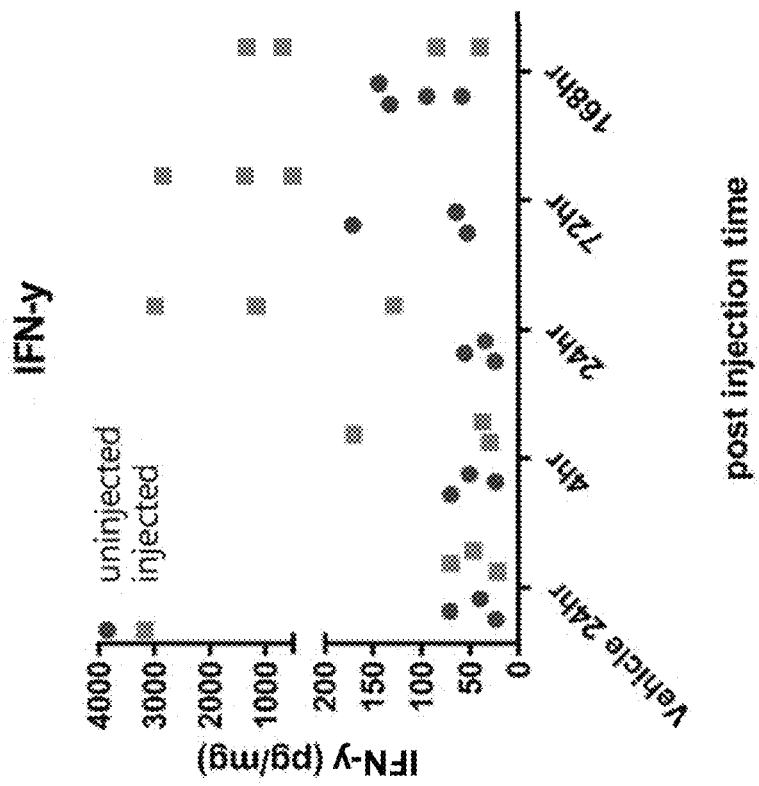

FIG. 62A shows the expression level of interferon gamma in the injected and non-injected tumors. Treatment of mice with ONCR-153 induced an intra-tumoral IFNγ response in both injected and non-injected tumors. FIG. 62B shows the expression level of interferon gamma in the plasma of the host animal.

Figure 63:
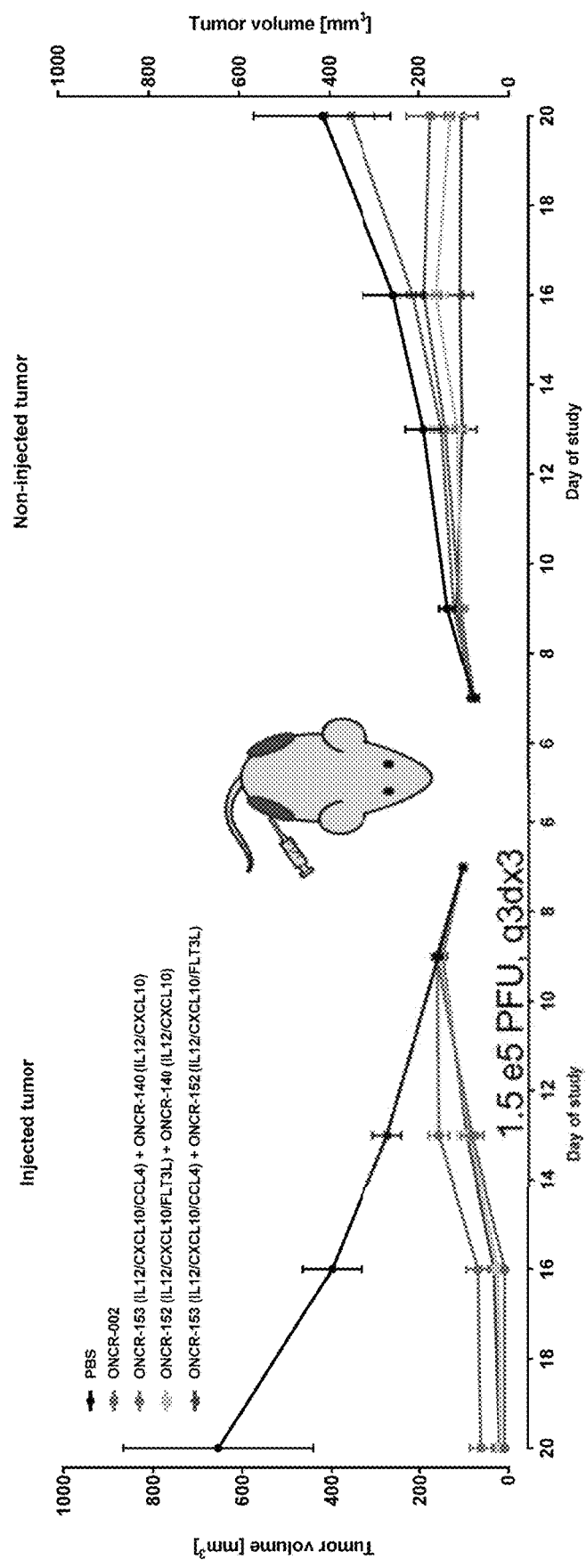

FIG. 63 shows tumor growth inhibitor effect of vehicle compared to virus (as indicated in legend) in a mouse xenograph experiment. The increase in tumor volume of the injected tumor is compared to the increase in tumor volume of the non-injected tumor.

Figure 64:
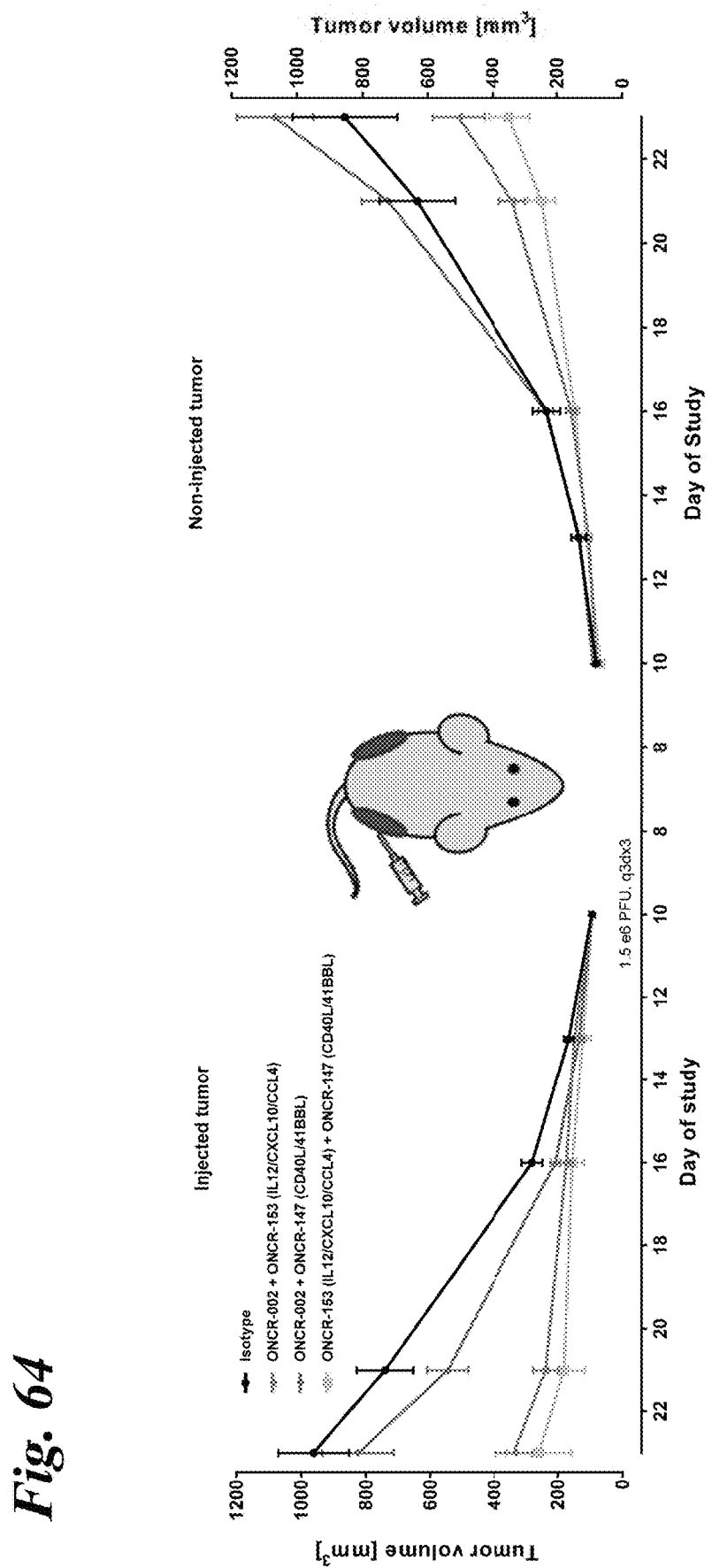

FIG. 64 shows tumor growth inhibitor effect of vehicle compared to virus (as indicated in legend) in a mouse xenograph experiment. The increase in tumor volume of the injected tumor is compared to the increase in tumor volume of the non-injected tumor.

Figure 65:
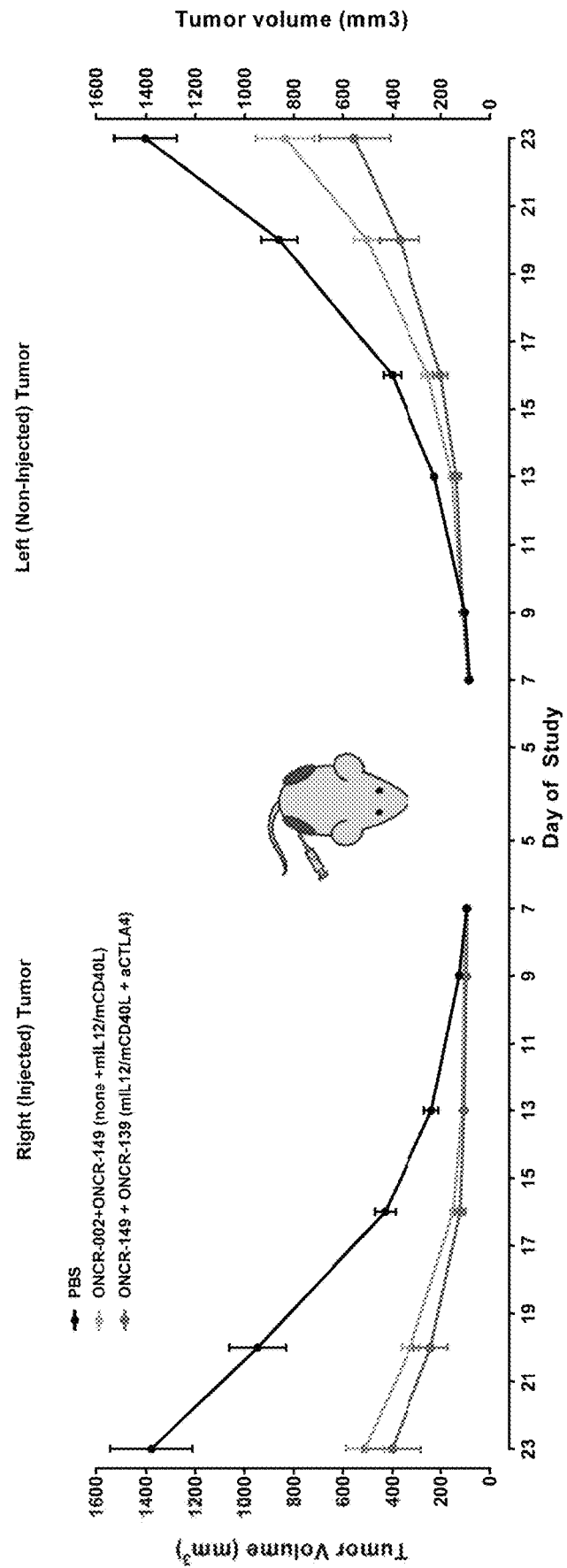

FIG. 65 shows tumor growth inhibitor effect of vehicle compared to virus (as indicated in legend) in a mouse xenograph experiment. The increase in tumor volume of the injected tumor is compared to the increase in tumor volume of the non-injected tumor.

Figure 66A:
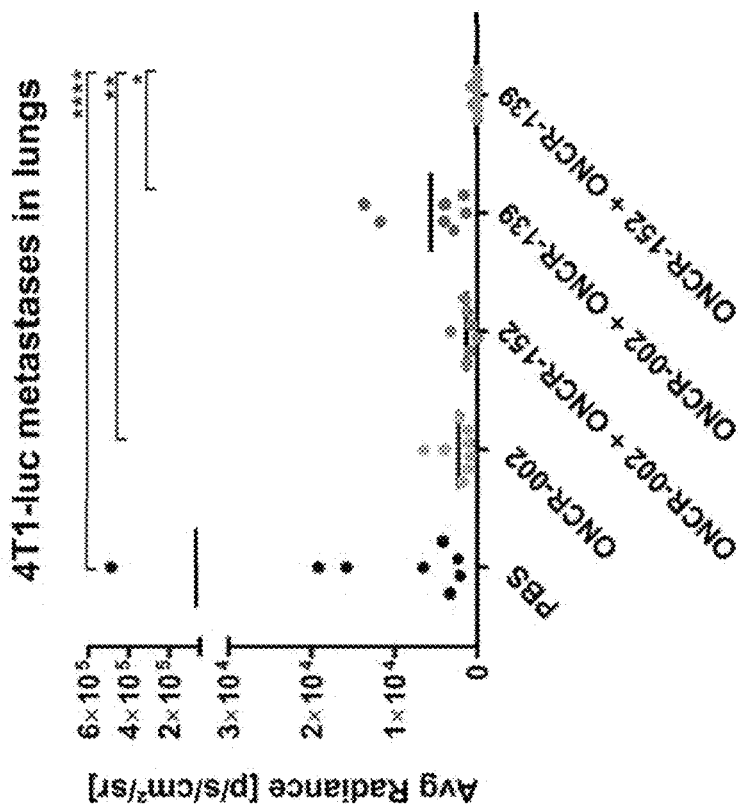
Figure 66B:
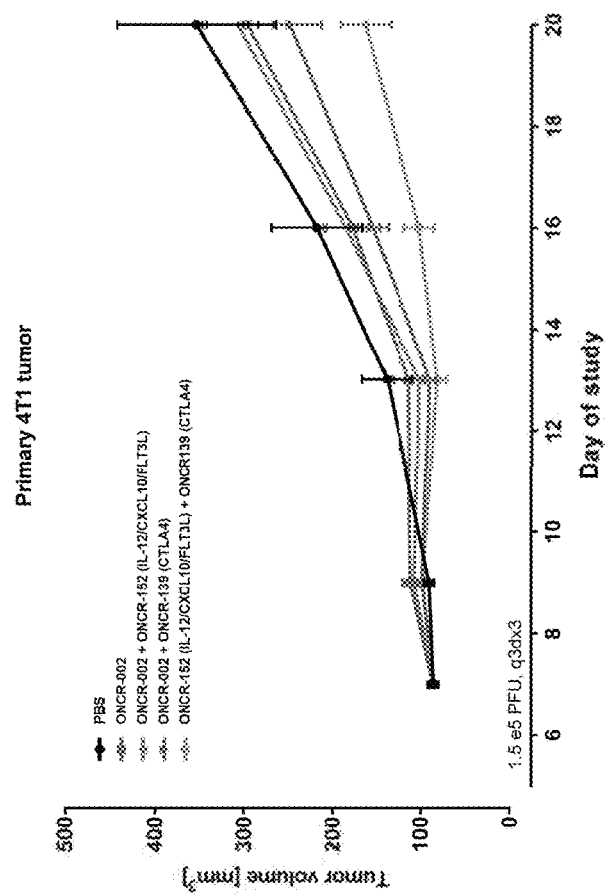
Figure 66C:
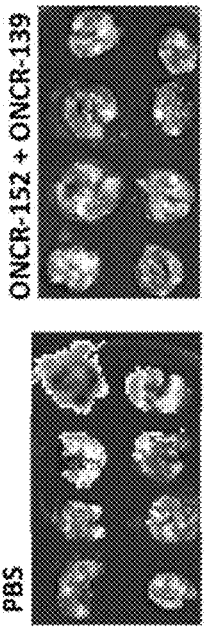

FIG. 66A shows tumor growth inhibitor effect of vehicle compared to virus (as indicated in legend) in a mouse xenograph experiment. FIG. 66B shows decreased incident of metastases to the lung. FIG. 66C shows images of lung tissue from vehicle (PBS) control or vector-treated animals.

Figure 67:
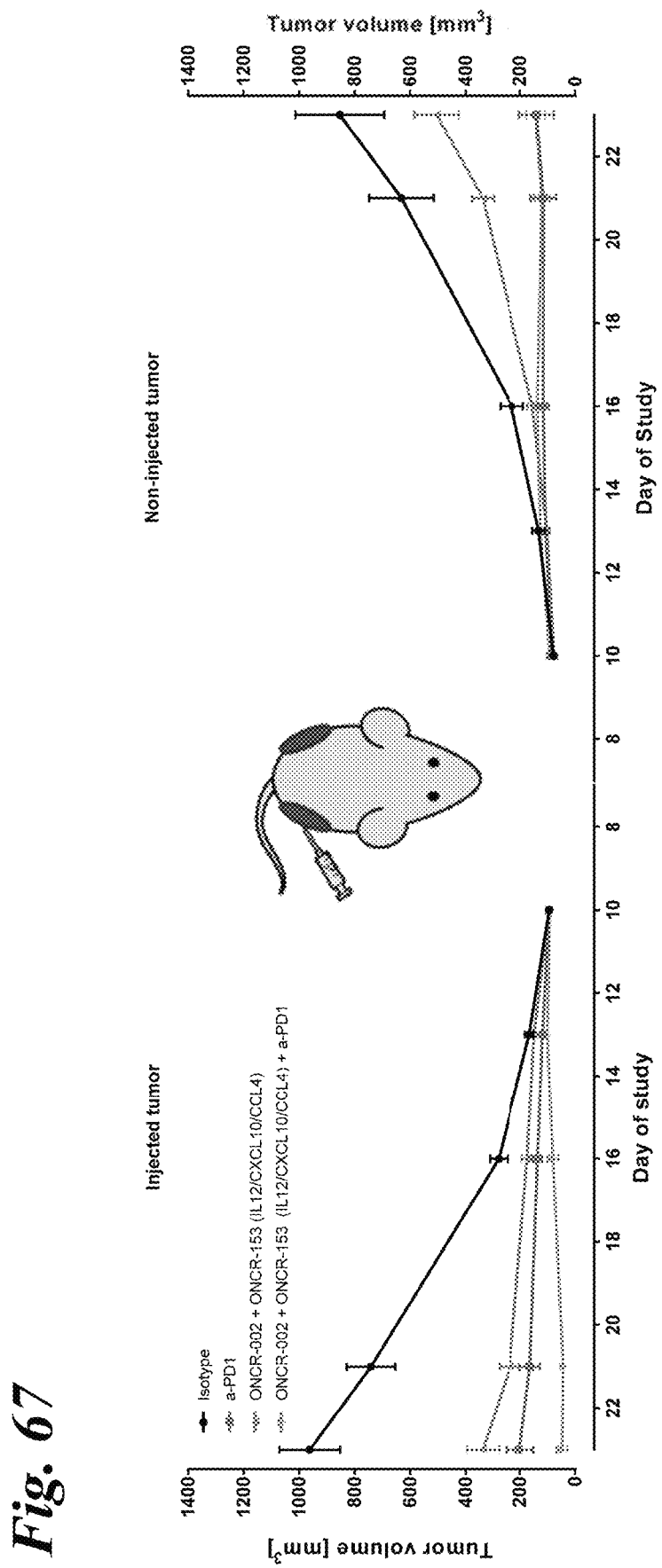

FIG. 67 shows tumor growth inhibitor effect of vehicle compared to virus (as indicated in legend) in a mouse xenograph experiment. The increase in tumor volume of the injected tumor is compared to the increase in tumor volume of the non-injected tumor. Treatment with ONCR-152 and -139 demonstrated an enhanced effect in tumor growth inhibition compared to treatment with ONCR-139 alone.

DETAILED DESCRIPTION

In some aspects, the present invention utilizes differential miR expression profiles to effectively restrict viral vector replication to tumor cells by incorporating miR target sequences into one or more genes required for viral replication. In particular embodiments, the viral vectors described herein comprise two, three, four or more copies of a miR target sequence incorporated into one or more viral genes. In some embodiments, the viral vectors described herein also disrupt the expression of specific miRNAs for reduced tumor proliferation, metastasis, and/or remodeling of the tumor microenvironment to enable enhanced viral spread. In some embodiments, the viral vectors described herein encompass the use of surface molecules on viral vectors to facilitate targeting to tumor cells. These aspects can be applied individually or in combination to develop viral vectors potentially capable of treating a wide array of cancer types with a single viral vector. As such, the invention further encompasses recombinant oncolytic viral vectors for use in the treatment and prevention of diseases and disorders (e.g., cancer). In some embodiments, this invention utilizes endogenous microRNA (miR) expression to enable a safe and efficacious recombinant viral vector suitable to treat a broad array of cancers.

The section headings used herein are for organizational purposes only and are not to be construed as limiting the subject matter described. All documents, or portions of documents, cited herein, including but not limited to patents, patent applications, articles, books, and treatises, are hereby expressly incorporated by reference in their entirety for any purpose. In the event that one or more of the incorporated documents or portions of documents define a term that contradicts that term's definition in the application, the definition that appears in this application controls. However, mention of any reference, article, publication, patent, patent publication, and patent application cited herein is not, and should not be taken as an acknowledgment, or any form of suggestion, that they constitute valid prior art or form part of the common general knowledge in any country in the world.

Definitions

In the present description, any concentration range, percentage range, ratio range, or integer range is to be understood to include the value of any integer within the recited range and, when appropriate, fractions thereof (such as one tenth and one hundredth of an integer), unless otherwise indicated. It should be understood that the terms "a" and "an" as used herein refer to "one or more" of the enumerated components unless otherwise indicated. The use of the alternative (e.g., "or") should be understood to mean either one, both, or any combination thereof of the alternatives. As used herein, the terms "include" and "comprise" are used synonymously. As used herein, "plurality" may refer to one or more components (e.g., one or more miRNA target sequences).

As used in this application, the terms "about" and "approximately" are used as equivalents. Any numerals used in this application with or without about/approximately are meant to cover any normal fluctuations appreciated by one of ordinary skill in the relevant art. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

"Decrease" or "reduce" refers to a decrease or a reduction in a particular value of at least 5%, for example, 5, 6, 7, 8, 9, 10, 15, 20, 25, 30, 35, 40, 45, 50, 55, 60, 65, 70, 75, 80, 85, 90, 95, 99 or 100% as compared to a reference value. A decrease or reduction in a particular value may also be represented as a fold-change in the value compared to a reference value, for example, at least 1, 2, 3, 4, 5, 6, 7, 8, 9, 10, 15, 20, 30, 40, 50, 60, 70, 80, 90, 100, 200, 500, 1000-fold, or more, decrease as compared to a reference value.

"Increase" refers to an increase in a particular value of at least 5%, for example, 5, 6, 7, 8, 9, 10, 15, 20, 25, 30, 35, 40, 45, 50, 55, 60, 65, 70, 75, 80, 85, 90, 95, 99, 100, 200, 300, 400, 500% or more as compared to a reference value. An increase in a particular value may also be represented as a fold-change in the value compared to a reference value, for example, at least 1-fold, 2, 3, 4, 5, 6, 7, 8, 9, 10, 15, 20, 30, 40, 50, 60, 70, 80, 90, 100, 200, 500, 1000-fold or more, increase as compared to the level of a reference value.

The term "sequence identity" refers to the percentage of bases or amino acids between two polynucleotide or polypeptide sequences that are the same, and in the same relative position. As such one polynucleotide or polypeptide sequence has a certain percentage of sequence identity compared to another polynucleotide or polypeptide sequence. For sequence comparison, typically one sequence acts as a reference sequence, to which test sequences are compared. The term "reference sequence" refers to a molecule to which a test sequence is compared.

"Complementary" refers to the capacity for pairing, through base stacking and specific hydrogen bonding, between two sequences comprising naturally or non-naturally occurring (e.g., modified as described above) bases (nucleosides) or analogs thereof. For example, if a base at one position of a nucleic acid is capable of hydrogen bonding with a base at the corresponding position of a target, then the bases are considered to be complementary to each other at that position. Nucleic acids can comprise universal bases, or inert abasic spacers that provide no positive or negative contribution to hydrogen bonding. Base pairings may include both canonical Watson-Crick base pairing and non-Watson-Crick base pairing (e.g., Wobble base pairing and Hoogsteen base pairing). It is understood that for complementary base pairings, adenosine-type bases (A) are complementary to thymidine-type bases (T) or uracil-type bases (U), that cytosine-type bases (C) are complementary to guanosine-type bases (G), and that universal bases such as such as 3-nitropyrrole or 5-nitroindole can hybridize to and are considered complementary to any A, C, U, or T. Nichols et al., Nature, 1994; 369:492-493 and Loakes et al., Nucleic Acids Res., 1994; 22:4039-4043. Inosine (I) has also been considered in the art to be a universal base and is considered complementary to any A, C, U, or T. See Watkins and SantaLucia, Nucl. Acids Research, 2005; 33 (19): 6258-6267.

"Operably linked" refers to a juxtaposition wherein the components so described are in a relationship permitting them to function in their intended manner. For instance, a promoter is operably linked to a polynucleotide sequence if the promoter affects the transcription or expression of the polynucleotide sequence.

The term "subject" includes animals, such as e.g. mammals. In some embodiments, the mammal is a primate. In some embodiments, the mammal is a human. In some embodiments, subjects are livestock such as cattle, sheep, goats, cows, swine, and the like; or domesticated animals such as dogs and cats. In some embodiments (e.g., particularly in research contexts) subjects are rodents (e.g., mice, rats, hamsters), rabbits, primates, or swine such as inbred pigs and the like. The terms "subject" and "patient" are used interchangeably herein.

The term "effective amount" refers to the minimum amount of an agent or composition required to result in a particular physiological effect (e.g., an amount required to increase, activate, and/or enhance a particular physiological effect). The effective amount of a particular agent may be represented in a variety of ways based on the nature of the agent, such as mass/volume, # of cells/volume, particles/volume, (mass of the agent)/(mass of the subject), # of cells/(mass of subject), or particles/(mass of subject). The effective amount of a particular agent may also be expressed as the half-maximal effective concentration ($EC_{50}$), which refers to the concentration of an agent that results in a magnitude of a particular physiological response that is half-way between a reference level and a maximum response level.

The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

As used herein "pharmaceutically acceptable carrier, diluent or excipient" includes without limitation any adjuvant, carrier, excipient, glidant, sweetening agent, diluent, preservative, dye/colorant, flavor enhancer, surfactant, wetting agent, dispersing agent, suspending agent, stabilizer, isotonic agent, solvent, surfactant, and/or emulsifier which has been approved by the United States Food and Drug Administration as being acceptable for use in humans and/or domestic animals.

As used herein, the term "oncolytic virus" refers to a virus that has been modified to, or naturally, preferentially infect cancer cells.

The terms "microRNA," "miRNA," and "miR" are used interchangeably herein and refer to small non-coding endogenous RNAs of about 21-25 nucleotides in length that regulate gene expression by directing their target messenger RNAs (mRNA) for degradation or translational repression.

"Essential viral gene" as used herein refers to a viral gene that is required for one or more essential viral function, such as viral replication, viral packaging, or viral infectivity.

The term "vector" is used herein to refer to a nucleic acid molecule capable transferring or transporting another nucleic acid molecule. The transferred nucleic acid is generally linked to, e.g., inserted into, the vector nucleic acid molecule. A vector may include sequences that direct autonomous replication in a cell, or may include sequences sufficient to allow integration into host cell DNA.

General methods in molecular and cellular biochemistry can be found in such standard textbooks as Molecular Cloning: A Laboratory Manual, 3rd Ed. (Sambrook et al., HaRBor Laboratory Press 2001); Short Protocols in Molecular Biology, 4th Ed. (Ausubel et al. eds., John Wiley & Sons 1999); Protein Methods (Bollag et al., John Wiley & Sons 1996); Nonviral Vectors for Gene Therapy (Wagner et al. eds., Academic Press 1999); Viral Vectors (Kaplift & Loewy eds., Academic Press 1995); Immunology Methods Manual (I. Lefkovits ed., Academic Press 1997); and Cell and Tissue Culture: Laboratory Procedures in Biotechnology (Doyle & Griffiths, John Wiley & Sons 1998), the disclosures of which are incorporated herein by reference.

Oncolytic Viruses

In some embodiments, the present invention provides for recombinant oncolytic viruses, wherein one or more copies of one or more micro-RNA (miRNA) target sequences are inserted into a locus of one or more essential viral genes required for viral replication. Examples of oncolytic viruses are known in the art including, but not limited to, herpes simplex virus (HSV), an adenovirus, a polio virus, a vaccinia virus, a measles virus, a vesicular stomatitis virus, an orthomyxovirus, a parvovirus, a maraba virus or a coxsackievirus. In some embodiments, the oncolytic viruses described herein are referred to as recombinant viral vectors or oncolytic vectors.

In certain embodiments, an oncolytic virus described herein is a herpesvirus (for example, herpes simplex virus (e.g., HSV-1 or HSV-2)), an adenovirus, a polio virus, a vaccinia virus, a measles virus, a vesicular stomatitis virus, an orthomyxovirus, a parvovirus, a maraba virus or a coxsackievirus. In particular embodiments, the recombinant viral vector is an HSV capable of tumor-selective vector replication as described in International PCT Publication No. WO 2015/066042, which is incorporated by reference in its entirety.

HSV-based vectors and methods for their construction are described in, for example, U.S. Pat. Nos. 7,078,029, 6,261,552, 5,998,174, 5,879,934, 5,849,572, 5,849,571, 5,837,532, 5,804,413, and 5,658,724, and International Patent Applications WO 91/02788, WO 96/04394, WO 98/15637, and WO 99/06583, which are incorporated herein by reference in their entireties. The sequence of HSV is published (NCBI Accession No. NC_001806; see also McGoech et al., J. Gen. Virol, 69 (PT 7), 1531-1574 (1988)), which may facilitate designing HSV-based vectors of the invention. In some cases, the oncolytic virus of the invention is a herpes simplex virus (HSV) and comprises a deletion of the internal repeat (joint) region comprising one copy each of the diploid genes ICP0, ICP34.5, LAT, and ICP4 along with the promoter for the ICP47 gene.

In certain embodiments, the recombinant viral vector of the invention is an HSV that exhibits enhanced entry into cells, either through direct infection and/or lateral spread. In one aspect, HSV vectors of the present invention can directly infect cells through interaction with cell proteins other than typical mediators of HSV infection (e.g., other than nectin-1, HVEM, or heparan sulfate/chondroitin sulfate proteoglycans). In certain embodiments, the recombinant viral vector of the invention is an HSV and further comprises a mutation of the gB or gH gene that facilitates vector entry through non-canonical receptors. In another aspect, the invention provides an HSV vector further comprising mutant gH glycoproteins that exhibit lateral spread in cells typically resistant to HSV lateral spread, such as cells lacking gD receptors. In some embodiments, an HSV vector of the invention comprises one or more of the mutant gB or gH proteins as described in U.S. Patent Publication No. 2013/0096186, which is incorporated herein by reference in its entirety. In certain aspects, the mutant entry protein within an HSV vector is a glycoprotein involved with viral entry, such as gB, gH, and the mutant HSV vector can comprise mutated versions of both. However, the mutant entry protein can be any protein effecting entry of the HSV vector into cells. In certain embodiments, the mutant entry protein is other than gD, although the HSV vector can additionally comprise a mutant gD, such as containing a ligand or other desired mutation. Non-limiting mutations of gB or gH glycoprotein for use in the inventive HSV vector occur at one or more of the following residues: gB:D285, gB:A549, gB:S668, gH:N753, and gH:A778. In some embodiments, the inventive HSV vector comprises mutations at both gB:D285 and gB:A549, at both gH:N753 and gH:A778, and/or at each of gB:S668, gH:N753, and gH:A778. In certain embodiments, the HSV vector contains two or more of such mutations (e.g., 3 or more, 4 or more), and the HSV vector can comprise mutations in all five of these residues. In one embodiment, an HSV vector has mutations at gB:285, gB; 549, gH:753, and gH:778. The mutations are referred to herein relative to the codon (amino acid) numbering of the gD, gB, and gH genes of the HSV-1 strain KOS derivative K26GFP. The sequences for gB and gH of K26GFP differ from the sequences for gB as disclosed in GenBank (#AF311740 (incorporated herein by reference)) and for gH (GenBank #X03896 (incorporated herein by reference)) as reflected in Table 9 below.

TABLE 9

| | Amino acid position | AF311740 | K26GFP | Nucleotide position(s) | AF311740 | K26GFP |
|---|---|---|---|---|---|---|
| gB | 313 | T | S | 938-939 | ACG | AGC |
| | 315 | A | T | 943 | GCC | ACC |
| | 515 | H | R | 1,544 | CAC | CGC |
| | | X03896 | | | | |
| gH | 12 | I | L | 1,011 | ATT | CTT |
| | 110 | P | S | 1,305 | CCG | TCG |
| | 127 | T | I | 1,357 | ACC | ATC |
| | 138 | S | A | 1,389 | TCG | GCG |
| | 150 | A | T | 1,425 | GCC | ACC |
| | 532 | A | A | 2,573 | GCT | GCG |
| | 633 | R | R | 2,876 | CGT | CGC |

However, K26GFP may contain additional differences in the region of the gene corresponding to nucleotides 2,079-2,102 of GenBank X03896. Thus, it will be understood that the sequence of either KOS derivative K26GFP or GenBank Accession No. AF311740 can serve as a reference sequence for the gB mutations discussed herein. Also, the sequence of either KOS derivative K26GFP or GenBank Accession No. X03896 can serve as a reference sequence for the gH mutations discussed herein. However, HSV vectors of the invention may include homologous mutations in gB and gH of any HSV strain.

In some aspects, the mutation of the entry protein for inclusion in an HSV vector is a substitution mutation; however, mutations are not limited to substitution mutants. In certain embodiments, mutant gB or gH glycoproteins for use in an HSV vector are selected from the group of substitution mutations consisting of gB:D285N, gB:A549T, gB:S668N, gH:N753K, gH:A778V. In certain aspects, an HSV vector includes combinations of these substitutions (such as two or more of such substitutions (e.g., 3 or more, 4 or more, or all)), with the gB:D285N/gB:A549T double mutant, the gH:N753K/gH:A778V double mutant, and the gB:S668N/gH:N753K/gH:A778V triple mutant being examples of embodiments. In one embodiment, an HSV vector comprises gB:D285N/gB:A549T/gH:N753K/gH:A778V.

In certain aspects, an HSV vector comprises a mutant gB and/or a mutant gH glycoprotein, wherein the mutations in the glycoproteins are substitution mutations in at least two residues, wherein, when the vector is HSV-1 K26GFP, the at least two residues are selected from the group consisting of gB:D285, gB:A549, gB:S668, gH:N753, and gH:A778, or wherein when the vector is a homologous HSV, the at least two residues are selected from amino acids that correlate to gB:D285, gB:A549, gB:S668, gH:N753, and gH:A778 wherein the gB:D285 residue correlates to X in VYPYXEFVL (SEQ ID NO: 838), the gB:A549 residue correlates to X in KLNPNXIAS (SEQ ID NO: 839), the gB:S668 residue correlates to X in ITTVXTFID (SEQ ID NO: 840) the gH:N753 residue correlates to X in VDTDXTQQQ (SEQ ID NO: 841), and the gH:A778 residue correlates to X in VPSTXLLLF (SEQ ID NO: 842); and wherein the HSV vector is an HSV-1 or HSV-2 vector.

In some embodiments, the oncolytic HSV viruses described herein comprise one or more mutations in the UL37 gene that reduce HSV infection of neuronal cells, such as those described in International PCT Publication No. WO 2016/141320 and Richard et al., Plos Pathogens, 2017, 13 (12), e1006741.

miRNA-Attenuated Oncolytic Viruses miRs are differentially expressed in a broad array of disease states, including multiple types of cancer. Importantly, miRNAs are differentially expressed in cancer tissues compared to normal tissues, enabling them to serve as a targeting mechanism in a broad variety of cancers. miRNAs that are associated (either positively or negatively) with carcinogenesis, malignant transformation, or metastasis are known as "oncomiRs".

In some aspects, the expression level of a particular oncomiR is positively associated with the development or maintenance of a particular cancer. Such miRs are referred to herein as "oncogenic miRs." In some embodiments, the expression of an oncogenic miR is increased in cancerous cells or tissues compared to the expression level observed in non-cancerous controls cells (i.e., normal or healthy controls) or is increased compared to the expression level observed in cancerous cells derived from a different cancer type. In some embodiments, the expression of an oncogenic miR is increased by at least 5%, 10%, 15%, 20%, 25%, 30%, 35%, 40%, 45%, 50%, 60%, 70%, 80%, 90%, 100%, 150%, 200%, 300%, 400%, 500%, 1000% or more compared to the expression of the oncogenic miR in a non-cancerous control cell or a cancerous cell derived from a different cancer type. In some aspects, a cancerous cell or tissue may express an oncogenic miR that is not expressed in non-cancerous control cells or tissues. Examples of oncogenic miRNAs that are frequently over-expressed in cancer tissues include, but are not limited to, miR-21, miR-155 and miR-17-92. Additional examples of oncogenic miRs are listed in Table 4.

In some embodiments, the expression of a particular oncomiR is negatively associated with the development or maintenance of a particular cancer and/or metastasis. Such oncomiRs are referred to herein as "tumor-suppressor miRs" or "tumor-suppressive miRs," as their expression prevents or suppresses the development of cancer. In some embodiments, the expression of a tumor-suppressor miRNA is decreased in cancerous cells or tissues compared to the expression level observed in non-cancerous control cells (i.e., normal or healthy controls), or is decreased compared to the expression level of the tumor-suppressor miRNA observed in cancerous cells derived from a different cancer type. For example, the expression of a tumor-suppressor miRNA in a cancerous cell may be decreased by at least 5%, 10%, 15%, 20%, 25%, 30%, 35%, 40%, 45%, 50%, 60%, 70%, 80%, 90%, or 100% compared to the expression of the tumor-suppressor miRNA in a non-cancerous control cell or a cancerous cell derived from a different cancer type. In some aspects, a non-cancerous control cell may express a tumor-suppressor miRNA that is not expressed in cancerous cells. Examples of tumor-suppressive miRNAs include, but are not limited to, miR-122, miR-184, miR-34a, let7a, miR-145-5p, miR-199a-5p, miR-451a, miR-125a, miR-125a-5p, miR-126-3p, miR-233-3p, miR-143-3p, miR-1-3p, miR-133a-3p, miR-127a-3p, miR-133b, miR-134-3p, miR-124, miR-101, miR-125b, miR-145, miR-559, miR-213, miR-31-5p, miR-205p, miR-15a, miR-16-1, miR-34, as well as miRNAs of the let-7 family. Additional examples of tumor-suppressive miRs are listed in Table 3 and Table 8.

Cancer pathogenesis is a heterogeneous and multigenic process. As such, activation of particular pathways and the expression of particular genes may lead to cancer development in one context, and result in distinct or opposing results when activated or expressed in a different context. Therefore, the characterization of a particular gene or miR as an "oncogene" or "oncogenic miR" or as a "tumor-suppressor" or "tumor-suppressive miR" is not a binary distinction and will vary according to the type of cancer. For example, the expression of one miRNA may be increased in a particular cancer and associated with the development of that cancer, while the expression of the same miRNA may be decreased in a different cancer and associated with prevention of the development of that cancer. However, some miRNAs may function as oncogenic miRNAs independent of the type of cancer. For example, some miRNAs target mRNA transcripts of tumor suppressor genes for degradation, thereby reducing expression of the tumor suppressor protein. For example, miR-152b functions as an oncogenic miR in the vast majority of hematologic malignancies, but functions as a tumor-suppressive miR in many solid tumors. Further, a particular miR may be highly expressed in both cancerous and non-cancerous cells. For example, miR-155 is highly expressed in normal cells, playing an essential role in macrophage polarization, and is also highly expressed in cancer cells. As such, the development of the miR-attenuated, genome-editing, and microenvironment-remodeling oncolytic viruses described herein is based on the differential expression of a particular miR or group of miRs in one cell population or tissue compared to another cell population or tissue. One of skill in the art will understand that the term tumor-suppressive miR generally refers to a miR that is more highly expressed in a non-cancerous cell or tissue compared to a cancerous cell or tissue, and that the term oncogenic miR generally refers to a miR that is more highly expressed in a cancerous cell or tissue compared to a non-cancerous cell or tissue. One of skill in the art will further understand that a miR characterized as a tumor-suppressive miR in one type of cancer may or may not function as a tumor-suppressive miR in a different type of cancer, and that a miR characterized as an oncogenic miR in one type of cancer may or may not function as an oncogenic miR in a different type of cancer.

Table 1 shows the relationship between 12 select oncomiRs (9 tumor suppressors and 3 oncogenic miRNAs) and numerous cancers. A list of 3,410 oncomiR-cancer relationships is shown in Table 2. miRNAs regulate many transcripts of proteins that are involved in the control of cellular proliferation and apoptosis. Regulated proteins include conventional proto-oncoproteins and tumor suppressors such as Ras, Myc, Bcl2, PTEN and p53. Aberrant expression of miRNAs therefore often is involved in development of cancer and can therapeutically be corrected by either inhibiting oncogenic miRNAs or replacing the depleted tumor suppressor miRNA. Further, the differential expression of particular oncomiRs in cancerous vs. non-cancerous cells can be exploited as a means to target cancer therapeutics specifically to cancer cells. As such, in some embodiments, the oncolytic viral vectors described herein can comprise the following properties individually or in combination: insertion of miRNA target sequences into the viral genome, thereby restricting viral vector replication to cancer or tumor cells; one or more polynucleotides incorporated into the viral genome whose product(s) disrupt the function of an oncogenic miRNA, modulate the cancer extracellular matrix, and/or enhance or activate an anti-cancer immune response; and/or protease-activated antibodies incorporated into the viral particle in order to selectively target the vectors to cancer and/or tumor cells.

One aspect of the invention comprises a recombinant oncolytic virus (or viral vector) comprising a plurality of copies of one or more miRNA target sequences inserted into a locus of one or more essential viral genes. In certain embodiments, a recombinant oncolytic virus may comprise miRNA target sequences inserted into a locus of at least one, at least two, at least three, at least four, at least five, at least six, at least seven, at least eight, at least nine, or at least ten essential viral genes. miRNAs expressed in normal (non-cancerous) cells can bind to such target sequences and suppress expression of the viral gene containing the miRNA target sequence, thereby limiting viral replication in healthy, non-cancerous cells. Such recombinant oncolytic viruses are referred to herein as "miR-attenuated" or "replication-restricted" as they demonstrate reduced or attenuated viral replication in cells that express one or more miRNAs capable of binding to the incorporated miR target sequences compared to cells that do not express, or have reduced expression of, the miR. By incorporating miRNA target sequences into key genes required for viral replication, viral replication can be conditionally suppressed in normal diploid cells expressing the miRNAs and can proceed normally in cells that do not express themiRNAs. In such embodiments, healthy, non-cancerous cells are protected from the normal cells from lytic effects of infection by the recombinant viral vector.

In certain embodiments, the one or more miRNA target sequences is incorporated into the 5' untranslated region (UTR) and/or 3' UTR of one or more essential viral genes. In some embodiments, the oncolytic virus is a herpes simplex virus (HSV), and the viral genes required for viral replication include any of UL1, UL5, UL6, UL7, UL8, UL9, UL11, UL12, UL14, UL15, UL17, UL18, UL19, UL20, UL22, UL25, UL26, UL26.5, UL27, UL28, UL29, UL30, UL31, UL32, UL33, UL34, UL35, UL36, UL37, UL38, UL39, UL40, UL42, UL48, UL49, UL52, UL53, UL54, ICP0, ICP4, ICP22, ICP27, ICP34.5, ICP47, gamma-34.5, US3, US4, US5, US6, US7, US8, US9, US10, US11, and/or US12. In certain embodiments, the oncolytic virus is HSV and comprises one or more miRNA target sequences incorporated into the 5' or 3' UTR of one or more essential viral genes. In some embodiments, the oncolytic virus is HSV, and the one or more miRNA target sequences is incorporated into one or more of ICP4, ICP27, UL8, UL42, UL19, and ICP34.5. In some embodiments, the oncolytic virus is HSV, and the one or more miRNA target sequences is incorporated into the 5' or 3' UTR of one or more of ICP4, ICP27, UL8, UL42, UL19, and ICP34.5 miRNA Target Sequence Cassettes

In animals, genes for miRNAs are transcribed to a primary miRNA (pri-miRNA), which is then processed in the nucleus by Drosha, a class 2 RNase III enzyme, to form a precursor miRNA (pre-miRNA) hairpin. The pre-miRNA hairpin are transported to the cytoplasm, where they are cleaved by the RNase III enzyme Dicer. This endoribonuclease interacts with 5' and 3' ends of the hairpin and cuts away the loop joining the 3' and 5' arms, yielding a duplex RNA molecule about 22 nucleotides in length. Although either strand of the duplex may potentially act as a functional miRNA, typically one strand of the miRNA is degraded and only one strand is loaded onto the Argonaute (Ago) protein to produce the effector RNA-induced silencing complex (RISC) where the miRNA and its mRNA target interact (Wahid et al., 1803:11, 2010, 1231-1243).

Herein, the gene encoding a particular miRNA is referenced as "MIR" followed by the miRNA number. The intermediate hairpin pre-miRNA molecules are referenced as "mir-" followed by the miRNA number, while the mature single-stranded miRNA molecule is referenced as "miR-" followed by the miRNA number. For example, "MIR122" refers to the gene encoding a hairpin mir-122 pre-miRNA molecule, which is then processed into a mature miR-122 molecule. Due to the hairpin structure of the pre-miRNA, it is possible that two mature microRNAs can originate from opposite arms of the same pre-miRNA. In some instances, expression data clearly identify one strand as the predominantly expressed miRNA and the other as the minor product. In such instances, the mature miRNA sequences are assigned names of the form miR-## (the predominant product) and miR-##* (minor product from the opposite arm of the precursor). For example, the major and minor products of mir-56 are denoted as miR-56 and miR-56*, respectively. When the existing data are not sufficient to determine which sequence is the predominant one, or when they are found in roughly similar amounts, the two mature miRNA products are denoted as miR-##-5p (from the 5' arm of the pre-miRNA hairpin) and miR-##-3p (from the 3' arm of the pre-miRNA hairpin). For example, the two mature miRNA products of mir-142 are denoted as miR-142-5p and miR-142-3p. Because they originate from opposite ends of the pre-miRNA hairpin, the -3p and -5p products of a particular miRNA will comprise different RNA sequences and will therefore recognize different target sequences.

Herein, miRNA target sequences are inserted into the locus of one or more essential viral genes in the form of a "miR target sequence cassette" or "miR-TS cassette." A miR-TS cassette which refers to a polynucleotide sequence comprising one or more miRNA target sequences and capable of being inserted into a specific locus of a viral gene. When transcribed, the mRNA transcripts of a viral gene comprising a miR-TS cassette will comprise one or more miRNA target sequences. In some embodiments, the miR-TS cassettes described herein comprise at least one miRNA target sequence. In some embodiments, the miR-TS cassettes described herein comprise a plurality of miRNA target sequences. For example, in some embodiments, the miR-TS cassettes described herein comprise 2, 3, 4, 5, 6, 7, 8, 9, 10, 11, 12, 13, 14, 15, 16, 17, 18, 19, 20, or more miRNA target sequences. In such embodiments, wherein the miR-TS cassettes comprise two or more miRNA target sequences, the two or more target sequences are arranged such that the total length of the miR-TS cassette (m) is less than or equal to the average length of the miRNA target sequences (n) multiplied by the total number of miRNA target sequences in the cassette (y) plus the average length of a linker sequence (l) multiplied by the total number of miRNA target sequences in the cassette plus 1 (y+1). Thus, the length of a miR-TS cassette (m) can be represented by the formula: $m \leq (n*y) + (l*(y+1))$, wherein n=the average length of the miRNA target sequences, l=the average length of the linker sequences, and y=the total number of target sequences in the miR-TS cassette). As an illustrative example, if a miR-TS cassettes comprises 4 miRNA target sequences (y) with an average length of 21 nt (n), and the average length of the linker sequences is between 4 and 25 nt (l), the length of the miR-TS cassette (m) is between about 104 nt and about 205 nt.

As used herein, the "length" of a miR-TS cassette is defined as the total number of nucleotides (basepairs for double-stranded polynucleotides) from the 5' nucleotide of the first miR-TS to the 3' nucleotide of the last miR-TS in the polynucleotide, inclusive of any intervening sequences. For non-overlapping miR-TSs, the minimum length of a miR-TS cassette will be the sum of the lengths of the miR-TSs. Spacers increase the length. The choice of spacer length determines the number of additional nucleotides in the cassette. Longer spacers increase the length of the cassette more than shorter spacers. By recognizing that shorter spacers (as short as 0, 1, 2, 3, 4, 5, or 6 nt) can be used when miR-TSs are interleaved (minimizing the number of mi-TSs for the same miRNA that are adjacent to one another)—the interleaved miR-TSs serving to increase the space between the other miR-TSs—the present inventors have determined that it is possible to generate shorter miR-TS cassettes than is possible in miR-TS cassettes in which miR-TSs for the same miRNA are arrayed in tandem, e.g. four of one type followed by four of the next type. In some embodiments, the length of the miR-TS cassette is less than 1000 nt. In some embodiments, the length of the miR-TS cassette is less than 900 nt, less than 800 nt, less than 700 nt, less than 600 nt, less than 500 nt, less than 400 nt, less than 300 nt, less than 200 nt, less than 100 nt, or less than 50 nt. In some embodiments, the length of the miR-TS cassette is less than 26, 27, 28, 29, or 30 nt times the number of miR-TS sites, less than about 30 nt times the number of miR-TS sites, less than about 35 nt times the number of miR-TS sites, or less than about 40 nt times the number of miR-TS sites.

In some embodiments, the miR-TS cassettes comprise a plurality miRNA target sequences, wherein each miRNA target sequence in the plurality is a target sequence for the same miRNA. For example, the miR-TS cassettes may comprise 2, 3, 4, 5, 6, 7, 8, 9, 10 or more copies of the same miR target sequence. In some embodiments, the miR-TS cassettes comprise between 2 to 6 copies of the same miR target sequence. In some embodiments, the miR-TS cassettes comprise 3 copies of the same miR target sequence. In some embodiments, the miR-TS cassettes comprise 4 copies of the same miR target sequence.

In some embodiments, the miR-TS cassettes described herein comprise a plurality of miRNA target sequences, wherein the plurality comprises at least two different miRNA target sequences. In some embodiments, the miR-TS cassettes described herein comprise 2, 3, 4, 5, 6, 7, 8, 9, or 10 different miRNA target sequences. For example, in some embodiments, the miR-TS cassette may one or more copies of a first miRNA target sequence and one or more copies of a second miRNA target sequence. In some embodiments, the miR-TS cassette comprises at least 2, 3, 4, 5, 6, 7, 8, 9, 10, or more copies of a first miR target sequence and at least 2, 3, 4, 5, 6, 7, 8, 9, 10, or more copies of a second miR target sequence. In some embodiments, the miR-TS cassette comprises 3 or 4 copies of a first miR target sequence and 3 or 4 copies of a second miR target sequence. In some embodiments, the plurality of miRNA target sequences comprises at least 3 different miRNA target sequences. For example, in some embodiments, the miR-TS cassette comprises one or more copies of a first miR target sequence, one or more copies of a second miR target sequence, and one or more copies of a third miR target sequence. In some embodiments, the miR-TS cassette comprises at least 2, 3, 4, 5, 6, 7, 8, 9, 10, or more copies of a first miR target sequence, at least 2, 3, 4, 5, 6, 7, 8, 9, 10, or more copies of a second miR target sequence, and at least 2, 3, 4, 5, 6, 7, 8, 9, 10, or more copies of a third miR target sequence. In some embodiments, the miR-TS cassette comprises 3 or 4 copies of a first miR target sequence, 3 or 4 copies of a second miR target sequence, and 3 or 4 copies of a third miR target sequence. In some embodiments, the plurality of miRNA target sequences comprises at least 4 different miRNA target sequences. For example, in some embodiments, the miR-TS cassette comprises one or more copies of a first miR target sequence, one or more copies of a second miR target sequence, one or more copies of a third miR target sequence, and one or more copies of a fourth miR target sequence. In some embodiments, the miR-TS cassette comprises at least 2, 3, 4, 5, 6, 7, 8, 9, 10, or more copies of a first miR target sequence, at least 2, 3, 4, 5, 6, 7, 8, 9, 10, or more copies of a second miR target sequence, at least 2, 3, 4, 5, 6, 7, 8, 9, 10, or more copies of a third miR target sequence, and at least 2, 3, 4, 5, 6, 7, 8, 9, 10, or more copies of a fourth miR target sequence. In some embodiments, the miR-TS cassette comprises 3 or 4 copies of a first miR target sequence, 3 or 4 copies of a second miR target sequence, 3 or 4 copies of a third miR target sequence, and 3 or 4 copies of a fourth miR target sequence. In some embodiments, the miR-TS cassettes described herein comprise a plurality of miRNA target sequences, wherein In some aspects, wherein the miR-TS cassettes comprise a plurality of miRNA target sequences, the plurality of miRNA target sequences may arranged in tandem, without any intervening nucleic acid sequences. In some aspects, the plurality of miRNA target sequences may be separated by a linker sequence. In some embodiments, the linker sequence comprises 2, 3, 4, 5, 6, 7, 8, 9, 10, 15, 20, 25, or more nucleotides. In some embodiments, the linker sequence comprises about 4 to about 20 nucleotides. In further embodiments, the linker sequence comprises about 4 to about 16 nucleotides. As an illustrative embodiment, a miR-TS cassette may comprise 1, 2, 3, 4, 5, 6, 7, 8, 9, 10, or more of the following subunits: (a) a first miRNA target sequence-linker-a second miRNA target sequence, wherein adjacent subunits are separated by an additional linker sequence. In some embodiments, the first and the second miRNA target sequence are targets of the same miRNA. In some embodiments, the first and the second miRNA target sequence are targets of different miRNAs.

In some embodiments, miR-TS cassettes described herein comprise a miRNA target sequence that is at least 95%, at least 96%, at least 97%, at least 98%, or at least 99% identical to the reverse complement of a sequence selected from SEQ ID NOs: 1-803. In some embodiments, miR-TS cassettes described herein comprise a miRNA target sequence that comprises or consists of the reverse complement of a sequence selected from SEQ ID NOs: 1-803.

In some embodiments, the miR-TS cassettes described herein comprise at least 1, at least 2, at least 3, or at least 4 miR-122-5p target sequences. In some embodiments, the miR-122-5p target sequences are at least 95%, at least 96%, at least 97%, at least 98%, or at least 99% identical to SEQ ID NO: 804. In some embodiments, the miR-122-5p target sequences comprise or consist of SEQ ID NO: 804. In some embodiments, the miR-TS cassettes described herein comprise at least 1, at least 2, at least 3, or at least 4 miR-124-3p target sequences. In some embodiments, the miR-124-3p target sequences are at least 95%, at least 96%, at least 97%, at least 98%, or at least 99% identical to SEQ ID NO: 805. In some embodiments, the miR-124-3p target sequences comprise or consist of SEQ ID NO: 805. In some embodiments, the miR-TS cassettes described herein comprise at least 1, at least 2, at least 3, or at least 4 miR-125a-5p target sequences. In some embodiments, the miR-125a-5p target sequences are at least 95%, at least 96%, at least 97%, at least 98%, or at least 99% identical to SEQ ID NO: 806. In some embodiments, the miR-125a-5p target sequences comprise or consist of SEQ ID NO: 806.

In some embodiments, the miR-TS cassettes described herein comprise at least 1, at least 2, at least 3, or at least 4 miR-126-3p target sequences. In some embodiments, the miR-126-3p target sequences are at least 95%, at least 96%, at least 97%, at least 98%, or at least 99% identical to SEQ ID NO: 807 or SEQ ID NO: 808. In some embodiments, the miR-126-3p target sequences comprise or consist of SEQ ID NO: 807 or SEQ ID NO: 808. In some embodiments, the miR-TS cassettes described herein comprise at least 1, at least 2, at least 3, or at least 4 miR-127a-3p target sequences. In some embodiments, the miR-127a-3p target sequences are at least 95%, at least 96%, at least 97%, at least 98%, or at least 99% identical to SEQ ID NO: 809. In some embodiments, the miR-127a-3p target sequences comprise or consist of SEQ ID NO: 809.

In some embodiments, the miR-TS cassettes described herein comprise at least 1, at least 2, at least 3, or at least 4 miR-128-3p target sequences. In some embodiments, the miR-128-3p target sequences are at least 95%, at least 96%, at least 97%, at least 98%, or at least 99% identical to SEQ ID NO: 810 or SEQ ID NO: 811. In some embodiments, the miR-128-3p target sequences comprise or consist of SEQ ID NO: 810 or SEQ ID NO: 811. In some embodiments, the miR-TS cassettes described herein comprise at least 1, at least 2, at least 3, or at least 4 miR-129-3p target sequences. In some embodiments, the miR-129-3p target sequences are at least 95%, at least 96%, at least 97%, at least 98%, or at least 99% identical to SEQ ID NO: 812. In some embodiments, the miR-129-3p target sequences comprise or consist of SEQ ID NO: 812.

In some embodiments, the miR-TS cassettes described herein comprise at least 1, at least 2, at least 3, or at least 4 miR-129-5p target sequences. In some embodiments, the miR-129-5p target sequences are at least 95%, at least 96%, at least 97%, at least 98%, or at least 99% identical to SEQ ID NO: 813. In some embodiments, the miR-129-5p target sequences comprise or consist of SEQ ID NO: 813. In some embodiments, the miR-TS cassettes described herein comprise at least 1, at least 2, at least 3, or at least 4 miR-130b-3p target sequences. In some embodiments, the miR-130b-3p target sequences are at least 95%, at least 96%, at least 97%, at least 98%, or at least 99% identical to SEQ ID NO: 814. In some embodiments, the miR-130b-3p target sequences comprise or consist of SEQ ID NO: 814. In some embodiments, the miR-TS cassettes described herein comprise at least 1, at least 2, at least 3, or at least 4 miR-130b-5p target sequences. In some embodiments, the miR-130b-5p target sequences are at least 95%, at least 96%, at least 97%, at least 98%, or at least 99% identical to SEQ ID NO: 815. In some embodiments, the miR-130b-5p target sequences comprise or consist of SEQ ID NO: 815.

In some embodiments, the miR-TS cassettes described herein comprise at least 1, at least 2, at least 3, or at least 4 miR-133a-3p target sequences. In some embodiments, the miR-133a-3p target sequences are at least 95%, at least 96%, at least 97%, at least 98%, or at least 99% identical to SEQ ID NO: 816. In some embodiments, the miR-133a-3p target sequences comprise or consist of SEQ ID NO: 816. In some embodiments, the miR-TS cassettes described herein comprise at least 1, at least 2, at least 3, or at least 4 miR-133b-3p target sequences. In some embodiments, the miR-133b-3p target sequences are at least 95%, at least 96%, at least 97%, at least 98%, or at least 99% identical to SEQ ID NO: 817. In some embodiments, the miR-133b-3p target sequences comprise or consist of SEQ ID NO: 817. In some embodiments, the miR-TS cassettes described herein comprise at least 1, at least 2, at least 3, or at least 4 miR-134-3p target sequences. In some embodiments, the miR-134-3p target sequences are at least 95%, at least 96%, at least 97%, at least 98%, or at least 99% identical to SEQ ID NO: 818. In some embodiments, the miR-134-3p target sequences comprise or consist of SEQ ID NO: 818.

In some embodiments, the miR-TS cassettes described herein comprise at least 1, at least 2, at least 3, or at least 4 miR-137-3p target sequences. In some embodiments, the miR-137-3p target sequences are at least 95%, at least 96%, at least 97%, at least 98%, or at least 99% identical to SEQ ID NO: 819. In some embodiments, the miR-137-3p target sequences comprise or consist of SEQ ID NO: 819. In some embodiments, the miR-TS cassettes described herein comprise at least 1, at least 2, at least 3, or at least 4 miR-1-3p target sequences. In some embodiments, the miR-1-3p target sequences are at least 95%, at least 96%, at least 97%, at least 98%, or at least 99% identical to SEQ ID NO: 820. In some embodiments, the miR-1-3p target sequences comprise or consist of SEQ ID NO: 820. In some embodiments, the miR-TS cassettes described herein comprise at least 1, at least 2, at least 3, or at least 4 miR-143-3p target sequences. In some embodiments, the miR-143-3p target sequences are at least 95%, at least 96%, at least 97%, at least 98%, or at least 99% identical to SEQ ID NO: 821. In some embodiments, miR-143-3p target sequences comprise or consist of SEQ ID NO: 821.

In some embodiments, the miR-TS cassettes described herein comprise at least 1, at least 2, at least 3, or at least 4 miR-145-3p target sequences. In some embodiments, the miR-145-3p target sequences are at least 95%, at least 96%, at least 97%, at least 98%, or at least 99% identical to SEQ ID NO: 822. In some embodiments, the miR-145-3p target sequences comprise or consist of SEQ ID NO: 822. In some embodiments, the miR-TS cassettes described herein comprise at least 1, at least 2, at least 3, or at least 4 miR-145-5p target sequences. In some embodiments, the miR-145-5p target sequences are at least 95%, at least 96%, at least 97%, at least 98%, or at least 99% identical to SEQ ID NO: 823. In some embodiments, the miR-145-5p target sequences comprise or consist of SEQ ID NO: 823. In some embodiments, the miR-TS cassettes described herein comprise at least 1, at least 2, at least 3, or at least 4 miR-184-3p target sequences. In some embodiments, the miR-184-3p target sequences are at least 95%, at least 96%, at least 97%, at least 98%, or at least 99% identical to SEQ ID NO: 824. In some embodiments, the miR-184-3p target sequences comprise or consist of SEQ ID NO: 824.

In some embodiments, the miR-TS cassettes described herein comprise at least 1, at least 2, at least 3, or at least 4 miR-199a-3p target sequences. In some embodiments, the miR-199a-3p target sequences are at least 95%, at least 96%, at least 97%, at least 98%, or at least 99% identical to SEQ ID NO: 825. In some embodiments, the miR-199a-3p target sequences comprise or consist of SEQ ID NO: 825. In some embodiments, the miR-TS cassettes described herein comprise at least 1, at least 2, at least 3, or at least 4 miR-199a-5p target sequences. In some embodiments, the miR-199a-5p target sequences are at least 95%, at least 96%, at least 97%, at least 98%, or at least 99% identical to SEQ ID NO: 826. In some embodiments, the miR-199a-5p target sequences comprise or consist of SEQ ID NO: 826. In some embodiments, the miR-TS cassettes described herein comprise at least 1, at least 2, at least 3, or at least 4 miR-204-5p target sequences. In some embodiments, the miR-204-5p target sequences are at least 95%, at least 96%, at least 97%, at least 98%, or at least 99% identical to SEQ ID NO: 827. In some embodiments, the miR-204-5p target sequences comprise or consist of SEQ ID NO: 827.

In some embodiments, the miR-TS cassettes described herein comprise at least 1, at least 2, at least 3, or at least 4 miR-208b-3p target sequences. In some embodiments, the miR-208b-3p target sequences are at least 95%, at least 96%, at least 97%, at least 98%, or at least 99% identical to SEQ ID NO: 828. In some embodiments, the miR-208b-3p target sequences comprise or consist of SEQ ID NO: 828. In some embodiments, the miR-TS cassettes described herein comprise at least 1, at least 2, at least 3, or at least 4 miR-214-3p target sequences. In some embodiments, the miR-214-3p target sequences are at least 95%, at least 96%, at least 97%, at least 98%, or at least 99% identical to SEQ ID NO: 829. In some embodiments, the miR-214-3p target sequences comprise or consist of SEQ ID NO: 829. In some embodiments, the miR-TS cassettes described herein comprise at least 1, at least 2, at least 3, or at least 4 miR-217-5p target sequences. In some embodiments, the miR-217-5p target sequences are at least 95%, at least 96%, at least 97%, at least 98%, or at least 99% identical to SEQ ID NO: 830. In some embodiments, the miR-217-5p target sequences comprise or consist of SEQ ID NO: 830.

In some embodiments, the miR-TS cassettes described herein comprise at least 1, at least 2, at least 3, or at least 4 miR-219a-5p target sequences. In some embodiments, the miR-219a-5p target sequences are at least 95%, at least 96%, at least 97%, at least 98%, or at least 99% identical to SEQ ID NO: 831. In some embodiments, the miR-219a-5p target sequences comprise or consist of SEQ ID NO: 831. In some embodiments, the miR-TS cassettes described herein comprise at least 1, at least 2, at least 3, or at least 4 miR-223-3p target sequences. In some embodiments, the miR-223-3p target sequences are at least 95%, at least 96%, at least 97%, at least 98%, or at least 99% identical to SEQ ID NO: 832. In some embodiments, the miR-223-3p target sequences comprise or consist of SEQ ID NO: 832. In some embodiments, the miR-TS cassettes described herein comprise at least 1, at least 2, at least 3, or at least 4 miR-34a-5p target sequences. In some embodiments, the miR-34a-5p target sequences are at least 95%, at least 96%, at least 97%, at least 98%, or at least 99% identical to SEQ ID NO: 833. In some embodiments, the miR-34a-5p target sequences comprise or consist of SEQ ID NO: 833.

n some embodiments, the miR-TS cassettes described herein comprise at least 1, at least 2, at least 3, or at least 4 miR-451a target sequences. In some embodiments, the miR-451a target sequences are at least 95%, at least 96%, at least 97%, at least 98%, or at least 99% identical to SEQ ID NO: 834. In some embodiments, the miR-451a target sequences comprise or consist of SEQ ID NO: 834. In some embodiments, the miR-TS cassettes described herein comprise at least 1, at least 2, at least 3, or at least 4 miR-559-5p target sequences. In some embodiments, the miR-559-5p target sequences are at least 95%, at least 96%, at least 97%, at least 98%, or at least 99% identical to SEQ ID NO: 835. In some embodiments, the miR-559-5p target sequences comprise or consist of SEQ ID NO: 835. In some embodiments, the miR-TS cassettes described herein comprise at least 1, at least 2, at least 3, or at least 4 miR-Let-7a-5p target sequences. In some embodiments, the miR-Let-7a-5p target sequences are at least 95%, at least 96%, at least 97%, at least 98%, or at least 99% identical to SEQ ID NO: 836. In some embodiments, the miR-Let-7a-5p target sequences comprise or consist of SEQ ID NO: 836. In some embodiments, the miR-TS cassettes described herein comprise at least 1, at least 2, at least 3, or at least 4 miR-9-5p target sequences. In some embodiments, the miR-9-5p target sequences are at least 95%, at least 96%, at least 97%, at least 98%, or at least 99% identical to SEQ ID NO: 837. In some embodiments, the miR-9-5p target sequences comprise or consist of SEQ ID NO: 837.

Table 10 below provides sequences of exemplary miRNAs that can bind to the miRNA target sequences in the oncolytic viruses described herein. Additional miRNA sequences are provided in SEQ ID NOs: 33-803.

TABLE 10

Exemplary miRNAs and Target Sequences

| miRNA | miRNA Sequence | SEQ ID: | miR-TS | SEQ ID: |
|---|---|---|---|---|
| 122-5p | uggagugugacaaugguguuug | 1 | caaacaccattgtcacactcca | 804 |
| 124-3p | uaaggcacgcggugaaugcc | 2 | ggcattcaccgcgtgcctta | 805 |
| 125a-5p | ucccugagacccuuuaaccuguga | 3 | tcacaggttaaagggtctcaggga | 806 |
| 126-3p | ucguaccgugaguaauaaugcg | 4 | cgcattattactcacggtacga | 807 |
| | | | cacattattactcacggtacga | 808 |
| 127a-3p | ucggauccgucugagcuuggcu | 5 | agccaagctcagacggatccga | 809 |
| 128-3p | ucacagugaaccggucucuuu | 6 | aaagagaccggttcactgtga | 810 |
| | | | aaagagaccggttcactgtgg | 811 |
| 129-3p | aagcccuuaccccaaaaaguau | 7 | atacttttggggtaagggctt | 812 |
| 129-5p | cuuuuugcggucugggcuugc | 8 | gcaagcccagaccgcaaaaag | 813 |
| 130b-3p | cagugcaaugaugaaagggcau | 9 | atgcccttt catcattgcactg | 814 |
| 130b-5p | acucuucccuguugcacuac | 10 | gtagtgcaacagggaaagagt | 815 |
| 133a-3p | uuugguccccuucaaccagcug | 11 | cagctggttgaaggggaccaaa | 816 |
| 133b-3p | uuugguccccuucaaccagcua | 12 | tagctggttgaaggggaccaaa | 817 |
| 134-3p | ccugugggccaccuagucaccaa | 13 | ttggtgactaggtggcccacagg | 818 |

TABLE 10 -continued

Exemplary miRNAs and Target Sequences

| miRNA | miRNA Sequence | SEQ ID: | miR-TS | SEQ ID: |
|---|---|---|---|---|
| 137_3p | uuauugcuuaagaauacgcguag | 14 | ctacgcgtattcttaagcaataa | 819 |
| 1-3p | uggaauguaaagaaguauguau | 15 | atacatacttctttacattcca | 820 |
| 143-3p | ugagaugaagcacuguagcuc | 16 | gagctacagtgcttcatctca | 821 |
| 145-3p | ggauuccuggaaauacuguucu | 17 | agaacagtatttccaggaatcc | 822 |
| 145-5p | guccaguuuucccaggaaucccu | 18 | agggattcctgggaaaactggac | 823 |
| 184-3p | uggacggagaacugauaagggu | 19 | acccttatcagttctccgtcca | 824 |
| 199a-3p | acaguagucugcacauugguua | 20 | taaccaatgtgcagactactgt | 825 |
| 199a-5p | cccaguguucagacuaccuguuc | 21 | gaacaggtagtctgaacactggg | 826 |
| 204-5p | uucccuuugucauccuaugccu | 22 | aggcataggatgacaaagggaa | 827 |
| 208b-3p | auaagacgaacaaaagguuugu | 23 | acaaaccttttgttcgtcttat | 828 |
| 214-3p | acagcaggcacagacaggcagu | 24 | actgcctgtctgtgcctgctgt | 829 |
| 217-5p | uacugcaucaggaacugauugga | 25 | tccaatcagttcctgatgcagta | 830 |
| 219a-5p | ugauuguccaaacgcaauucu | 26 | agaattgcgtttggacaatca | 831 |
| 223-3p | ugucaguuugucaaauacccca | 27 | tggggtatttgacaaactgaca | 832 |
| 34a-5p | uggcagugucuuagcugguugu | 28 | acaaccagctaagacactgcca | 833 |
| 451a | aaaccguuaccauuacugaguu | 29 | aactcagtaatggtaacggttt | 834 |
| 559-5p | uaaaguaaauaugcaccaaaa | 30 | ttttggtgcatatttactta | 835 |
| Let7a-5p | ugagguaguagguuguauaguu | 31 | aactatacaacctactacctca | 836 |
| 9-5p | ucuuugguuaucagcuguauga | 32 | tcatacagctagataaccaaaga | 837 |

In some embodiments, the miR-TS cassettes comprise one or more additional polynucleotide sequences that enable the cassette to be inserted into the locus of a viral gene. For example, a miR-TS cassette may further comprise short polynucleotide sequence on the 5' and 3' ends that are complementary to a nucleic acid sequence at a desired location in the viral genome. Such sequences are referred to herein as "homology arms" and facilitate the insertion of a miR-TS cassette into a specific location in the viral genome.

In some embodiments, the miR-TS cassettes disclosed comprise two or more pluralities of miR-TSs each corresponding to a different miRNA and the miR-TSs are selected to protect diverse cell types or organs from an oncolytic virus. In some embodiments, the pluralities of miR-TSs are interleaved rather than in tandem to one another. In some embodiments, the miR-TS cassettes have short (e.g., 4-15 nt in length) spacers, resulting in a more compact cassette. In some embodiments, the miR-TS cassettes are free from (or have reduced) RNA secondary structures that inhibit activity of the miR-TSs. In some embodiments, the miR-TS cassettes are free from (or have reduced) seed sequences for miRNAs associated with carcinogenesis, malignant transformation, or metastasis (i.e., "oncomiRs"). In some embodiments, the miR-TS cassettes are free from (or have reduced) polyadenylation sites.

Oncolytic Viruses Comprising miR-TS Cassettes

In some embodiments, a recombinant oncolytic virus may comprise one miR-TS cassette incorporated into a locus of one essential viral gene, wherein the miR-TS cassette comprises a plurality of miRNA target sequences, such that the recombinant oncolytic virus comprises a plurality of miRNA target sequences incorporated into a locus of one essential viral gene. In some aspects, the miR-TS cassette may comprise a plurality of miRNA target sequences, wherein each miRNA target sequence of the plurality is a target for the same miRNA, such that the recombinant oncolytic virus comprises a plurality (e.g., 2, 3, 4, 5, 6, 7, 8, 9, 10 or more) copies of the same miRNA target sequence incorporated into a locus of an essential viral gene. For example, in some embodiments, a recombinant oncolytic HSV may comprise a miR-TS cassette comprising 2, 3, 4, 5, 6 or more target sequences inserted into one of ICP4, ICP27, ICP8, ICP22, ICP34.5, UL5, UL8, UL9, UL30, UL39/40, or UL42. In some embodiments, a recombinant oncolytic HSV may comprise a miR-TS cassette comprising 2, 3, 4, or more target sequences inserted into one of ICP8, ICP22, ICP34.5, UL5, UL8, UL9, UL30, UL39/40, or UL42. In some embodiments, a recombinant oncolytic HSV may comprise a miR-TS cassette comprising 2, 3, 4, 5, 6 or more target sequence inserted into one of ICP4, ICP27, ICP34.5, UL8, or UL9.

In some aspects, the plurality of miRNA target sequences comprises at least two different miRNA target sequences, at least three different miRNA target sequences, or at least four different miRNA target sequences, such that the recombinant oncolytic virus comprises one or more copies of at least 2, 3, or 4 different miRNA target sequence incorporated into a locus of an essential viral gene. For example, in some embodiments, a recombinant oncolytic HSV may comprise a miR-TS cassette comprising one or more target sequences for miR-122-5p, miR-34a-5p, and miR-Let-7a-5p inserted into one of ICP4, ICP27, ICP8, ICP22, ICP34.5, UL5, UL8, UL9, UL30, UL39/40, or UL42. In some embodiments, a recombinant oncolytic HSV may comprise a miR-TS cassette comprising one or more target sequences for miR-122-5p, miR-34a-5p, and miR-Let-7a-5p inserted into one of ICP8, ICP22, ICP34.5, UL5, UL8, UL9, UL30, UL39/40, or UL42. In some embodiments, a recombinant oncolytic HSV may comprise a miR-TS cassette comprising one or more target sequences for miR-122-5p, miR-34a-5p, and miR-Let-7a-5p inserted into one of ICP4, ICP27, ICP34.5, UL8, or UL9. In some embodiments, a recombinant oncolytic HSV may comprise a miR-TS cassette comprising one or more target sequences for miR-122-5p, miR-184-3p, and miR-Let-7a-5p inserted into one of ICP4, ICP27, ICP8, ICP22, ICP34.5, UL5, UL8, UL9, UL30, UL39/40, or UL42. In some embodiments, a recombinant oncolytic HSV may comprise a miR-TS cassette comprising one or more target sequences for miR-122-5p, miR-184-3p, and miR-Let-7a-5p inserted into one of ICP8, ICP22, ICP34.5, UL5, UL8, UL9, UL30, UL39/40, or UL42. In some embodiments, a recombinant oncolytic HSV may comprise a miR-TS cassette comprising one or more target sequences for miR-122-5p, miR-184-3p, and miR-Let-7a-5p inserted into one of ICP4, ICP27, ICP34.5, UL8, or UL9.

In some embodiments, a recombinant oncolytic HSV may comprise a miR-TS cassette comprising one or more target sequences for miR-122-5p and miR-Let-7a-5p inserted into one of ICP4, ICP27, ICP8, ICP22, ICP34.5, UL5, UL8, UL9, UL30, UL39/40, or UL42. In some embodiments, a recombinant oncolytic HSV may comprise a miR-TS cassette comprising one or more target sequences for miR-122-5p and miR-Let-7a-5p inserted into one of ICP8, ICP22, ICP34.5, UL5, UL8, UL9, UL30, UL39/40, or UL42. In some embodiments, a recombinant oncolytic HSV may comprise a miR-TS cassette comprising one or more target sequences for miR-122-5p and miR-Let-7a-5p inserted into one of ICP4, ICP27, ICP34.5, UL8, or UL9. In some embodiments, a recombinant oncolytic HSV may comprise a miR-TS cassette comprising one or more target sequences for miR-145-5p, miR-199a-5p, and miR-599-5p inserted into one of ICP4, ICP27, ICP8, ICP22, ICP34.5, UL5, UL8, UL9, UL30, UL39/40, or UL42. In some embodiments, a recombinant oncolytic HSV may comprise a miR-TS cassette comprising one or more target sequences for miR-145-5p, miR-199a-5p, and miR-599-5p inserted into one of ICP8, ICP22, ICP34.5, UL5, UL8, UL9, UL30, UL39/40, or UL42. In some embodiments, a recombinant oncolytic HSV may comprise a miR-TS cassette comprising one or more target sequences for miR-145-5p, miR-199a-5p, and miR-599-5p inserted into one of ICP4, ICP27, ICP34.5, UL8, or UL9.

In some embodiments, a recombinant oncolytic HSV may comprise a miR-TS cassette comprising one or more target sequences for miR-124-3p, miR-1-3p, and miR-124-3p inserted into one of ICP4, ICP27, ICP8, ICP22, ICP34.5, UL5, UL8, UL9, UL30, UL39/40, or UL42. In some embodiments, a recombinant oncolytic HSV may comprise a miR-TS cassette comprising one or more target sequences for miR-124-3p, miR-1-3p, and miR-124-3p inserted into one of ICP8, ICP22, ICP34.5, UL5, UL8, UL9, UL30, UL39/40, or UL42. In some embodiments, a recombinant oncolytic HSV may comprise a miR-TS cassette comprising one or more target sequences for miR-124-3p, miR-1-3p, and miR-124-3p inserted into one of ICP4, ICP27, ICP34.5, UL8, or UL9. In some embodiments, a recombinant oncolytic HSV may comprise a miR-TS cassette comprising one or more target sequences for miR-219a-5p, miR-122-5p, and miR-128-3p inserted into one of ICP4, ICP27, ICP8, ICP22, ICP34.5, UL5, UL8, UL9, UL30, UL39/40, or UL42. In some embodiments, a recombinant oncolytic HSV may comprise a miR-TS cassette comprising one or more target sequences for miR-219a-5p, miR-122-5p, and miR-128-3p inserted into one of ICP8, ICP22, ICP34.5, UL5, UL8, UL9, UL30, UL39/40, or UL42. In some embodiments, a recombinant oncolytic HSV may comprise a miR-TS cassette comprising one or more target sequences for miR-219a-5p, miR-122-5p, and miR-128-3p inserted into one of ICP4, ICP27, ICP34.5, UL8, or UL9.

In some embodiments, a recombinant oncolytic HSV may comprise a miR-TS cassette comprising one or more target sequences for miR-137-3p, miR-208b-3p, and miR-126-3p inserted into one of ICP4, ICP27, ICP8, ICP22, ICP34.5, UL5, UL8, UL9, UL30, UL39/40, or UL42. In some embodiments, a recombinant oncolytic HSV may comprise a miR-TS cassette comprising one or more target sequences for miR-137-3p, miR-208b-3p, and miR-126-3p inserted into one of ICP8, ICP22, ICP34.5, UL5, UL8, UL9, UL30, UL39/40, or UL42. In some embodiments, a recombinant oncolytic HSV may comprise a miR-TS cassette comprising one or more target sequences for miR-137-3p, miR-208b-3p, and miR-126-3p inserted into one of ICP4, ICP27, ICP34.5, UL8, or UL9. In some embodiments, a recombinant oncolytic HSV may comprise a miR-TS cassette comprising one or more target sequences for miR-137-3p, miR-217-3p, and miR-126-3p inserted into one of ICP4, ICP27, ICP8, ICP22, ICP34.5, UL5, UL8, UL9, UL30, UL39/40, or UL42. In some embodiments, a recombinant oncolytic HSV may comprise a miR-TS cassette comprising one or more target sequences for miR-137-3p, miR-217-3p, and miR-126-3p inserted into one of ICP8, ICP22, ICP34.5, UL5, UL8, UL9, UL30, UL39/40, or UL42. In some embodiments, a recombinant oncolytic HSV may comprise a miR-TS cassette comprising one or more target sequences for miR-137-3p, miR-217-3p, and miR-126-3p inserted into one of ICP4, ICP27, ICP34.5, UL8, or UL9.

In some embodiments, a recombinant oncolytic HSV may comprise a miR-TS cassette comprising one or more target sequences for miR-128-3p, miR-204-5p, and miR-219-5p inserted into one of ICP4, ICP27, ICP8, ICP22, ICP34.5, UL5, UL8, UL9, UL30, UL39/40, or UL42. In some embodiments, a recombinant oncolytic HSV may comprise a miR-TS cassette comprising one or more target sequences for miR-128-3p, miR-204-5p, and miR-219-5p inserted into one of ICP8, ICP22, ICP34.5, UL5, UL8, UL9, UL30, UL39/40, or UL42. In some embodiments, a recombinant oncolytic HSV may comprise a miR-TS cassette comprising one or more target sequences for miR-128-3p, miR-204-5p, and miR-219-5p inserted into one of ICP4, ICP27, ICP34.5, UL8, or UL9.

In some embodiments, a recombinant oncolytic virus may comprise one miR-TS cassette incorporated into the 3' or 5' untranslated region (UTR) of the viral genome. In such embodiments, the miR-TS cassette may comprise one copy of a miRNA target sequence, such that the recombinant oncolytic virus comprises one copy of a miRNA target sequence incorporated into the 3' or 5' UTR of the viral genome. For example, in some embodiments, a recombinant polio virus, SVV, or Coxsackievirus may comprise a miR-TS cassette comprising a miRNA target sequence shown in Table 10 inserted into the 3' or 5' UTR of the viral genome. In some embodiments, a recombinant oncolytic virus may comprise one miR-TS cassette incorporated into the 3' or 5' UTR of the viral genome, wherein the miR-TS cassette comprises a plurality of miRNA target sequences shown in Table 10, such that the recombinant oncolytic virus comprises a plurality of miRNA target sequences incorporated into the 3' or 5' UTR of the viral genome.

In some aspects, the plurality of miRNA target sequences comprises at least two different miRNA target sequences, at least three different miRNA target sequences, or at least four different miRNA target sequences, such that the recombinant oncolytic virus comprises one or more copies of at least 2, 3, or 4 different miRNA target sequence incorporated into the 3' or 5' UTR of the viral genome. For example, in some embodiments, a recombinant polio virus, SVV, or Coxsackievirus may comprise a miR-TS cassette comprising one or more copies of at least 2, 3, or 4 different miRNA target sequences selected from Table 10 inserted into the 3' or 5' UTR of the viral genome.

In some embodiments, a recombinant oncolytic virus may comprise a miR-TS cassette incorporated into a locus of two or more essential viral genes. In some embodiments, the recombinant oncolytic virus is an HSV virus and the two or more essential viral genes are selected from the group consisting of ICP4, ICP27, ICP8, ICP22, ICP34.5, UL5, UL8, UL9, UL30, UL39/40, or UL42. In some embodiments, the recombinant oncolytic virus is an HSV virus and the two or more essential viral genes are selected from the group consisting of ICP8, ICP22, ICP34.5, UL5, UL8, UL9, UL30, UL39/40, or UL42. In some embodiments, the recombinant oncolytic virus is an HSV virus and the two or more essential viral genes are selected from the group consisting of ICP4, ICP27, ICP34.5, UL8, or UL9. In some embodiments, the recombinant oncolytic virus is an HSV virus and the two or more essential viral genes are selected from the group consisting of ICP27, ICP4, ICP34.5, UL8, and UL42.

In some embodiments, the recombinant oncolytic virus is an HSV virus comprising (i) a first miR-TS cassette comprising a plurality of miRNA target sequences inserted into a locus of ICP4 and a second miR-TS cassette comprising a plurality of miRNA target sequences into a locus of ICP27. In some embodiments, the first miR-TS cassette is inserted into a locus of ICP4 and comprises 1, 2, 3, or 4 copies of a target sequence for miR-124. In some embodiments, the first miR-TS cassette is inserted into a locus of ICP4 and comprises 1, 2, 3, or 4 copies of a target sequence for miR-124; 1, 2, 3, or 4 copies of a target sequence for miR-1-3p; and 1, 2, 3, or 4 copies of a target sequence for miR-143-3p. In some embodiments, the plurality of miRNA target sequences in the first miR-TS cassettes are arranged as follows:
  (a) (124-3p)-(124-3p)-(124-3p)-(124-3p);
  (b) (124-3p)-(124-3p)-(124-3p)-(124-3p)-(1-3p)-(143-3p)-(1-3p)-(143-3p)-(1-3p)-(143-3p).

In some embodiments, the second miR-TS cassette is inserted into a locus of ICP27 and comprises 1, 2, 3, or 4 copies of a target sequence for miR-1-3p; 1, 2, 3, or 4 copies of a target sequence for miR-145-5p; 1, 2, 3, or 4 copies of a target sequence for miR-199-5p; and 1, 2, 3, or 4 copies of a target sequence for miR-559. In some embodiments, the second miR-TS cassette is inserted into a locus of ICP27 and comprises 1, 2, 3, or 4 copies of a target sequence for miR-219a-5p; 1, 2, 3, or 4 copies of a target sequence for miR-122-5p; and 1, 2, 3, or 4 copies of a target sequence for miR-128.

In some embodiments, the first miR-TS cassette comprises 4 copies of a target sequence for miR-124 and the second miR-TS cassette comprises 2, 3, or more copies of a target sequence for each of 1-3p, 145-5p, 199a-5p, and 559. In some embodiments, the first miR-TS cassette comprises 4 copies of a target sequence for miR-124 and the second miR-TS cassette comprises 4 copies of a target sequence for each of 219a-5p, 122-5p, 128T.

In some embodiments, the recombinant oncolytic virus is an HSV virus comprising (i) a first miR-TS cassette comprising a plurality of miRNA target sequences inserted into a locus of ICP4; and (ii) a second miR-TS cassette comprising a plurality of miRNA target sequences inserted into a locus of UL42. In some embodiments, the first miR-TS cassette is inserted into a locus of ICP4 and comprises 1, 2, 3, or 4 copies of a target sequence for miR-124. In some embodiments, the plurality of miRNA target sequences in the second miR-TS cassettes are arranged as follows:
  (a) (124-3p)-(124-3p)-(124-3p)-(124-3p).

In some embodiments, the second miR-TS cassette is inserted into a locus of UL42 comprises 1, 2, 3, or 4 copies of a target sequence for miR-122-5p. In some embodiments, the plurality of miRNA target sequences in the second miR-TS cassettes are arranged as follows:
  (a) (122-5p)-(122-5p)-(122-5p).

In some embodiments, the recombinant oncolytic virus is an HSV virus comprising (i) a first miR-TS cassette comprising 4 copies of a target sequence for miR-124 inserted into a locus of ICP4; and (ii) a second miR-TS cassette comprising 3 copies of a target sequence for miR-122-5p inserted into a locus of UL42.

In some embodiments, the recombinant oncolytic virus is an HSV virus comprising (i) a first miR-TS cassette comprising a plurality of miRNA target sequences inserted into a locus of ICP4; (ii) a second miR-TS cassette comprising a plurality of miRNA target sequences inserted into a locus of ICP27; and (iii) a third miR-TS cassette comprising a plurality of miRNA target sequences is inserted into a locus of UL42. In some embodiments, the first miR-TS cassette is inserted into a locus of ICP4 and comprises 1, 2, 3, or 4 copies of a target sequence for miR-124. In some embodiments, the plurality of miRNA target sequences in the second miR-TS cassettes are arranged as follows:
  (a) (124-3p)-(124-3p)-(124-3p)-(124-3p).

In some embodiments, the second miR-TS cassette is inserted into a locus of ICP27 and comprises 1, 2, 3, or 4 copies of a target sequence for miR-122. In some embodiments, the plurality of miRNA target sequences in the second miR-TS cassettes are arranged according to one of the following:
  (a) (122-5p);
  (b) (122-5p)-(122-5p)-(122-5p)-(122-5p);
  (c) (122-5p)-(122-5p)-(122-5p).

In some embodiments, the third miR-TS cassette is inserted into a locus of UL42 and comprises 1, 2, 3, or 4 copies of a target sequence for miR-125-5p. In some embodiments, the plurality of miRNA target sequences in the third miR-TS cassettes are arranged according to one of the following:
  (a) (122-5p);
  (b) (122-5p)-(122-5p)-(122-5p)-(122-5p);
  (c) (122-5p)-(122-5p)-(122-5p).

In some embodiments, the recombinant oncolytic virus is an HSV virus comprising (i) a first miR-TS cassette inserted into a locus of ICP4 and comprising 4 copies of a target sequence for miRNA-124-3p; (ii) a second miR-TS cassette inserted into a locus of ICP27 and comprising 1, 2, 3, or 4 copies of a target sequence for miR-122-5p; and (iii) a third miR-TS cassette inserted into a locus of UL42 and comprising 4 copies of a target sequence for miR-125-5p. In some embodiments, the recombinant oncolytic virus is an HSV virus comprising (i) a first miR-TS cassette inserted into a locus of ICP4 and comprising 4 copies of a target sequence for miRNA-124; (ii) a second miR-TS cassette inserted into a locus of ICP27 and comprising 4 copies of a target sequence for miR-122; and (iii) a third miR-TS cassette inserted into a locus of UL42 and comprising 1, 2, 3, or 4 copies of a target sequence for miR-125-5p. In some embodiments, the recombinant oncolytic virus is an HSV virus comprising (i) a first miR-TS cassette inserted into a locus of ICP4 and comprising 4 copies of a target sequence for miRNA-124; (ii) a second miR-TS cassette inserted into a locus of ICP27 and comprising 4 copies of a target sequence for miR-122-3p; and (iii) a third miR-TS cassette inserted into a locus of UL42 and comprising 4 copies of a target sequence for miR-125-5p. In some embodiments, the recombinant oncolytic virus is an HSV virus comprising (i) a first miR-TS cassette inserted into a locus of ICP4 and comprising 4 copies of a target sequence for miRNA-124-3p; (ii) a second miR-TS cassette inserted into a locus of ICP27 and comprising 3 copies of a target sequence for miR-122-3p; and (iii) a third miR-TS cassette inserted into a locus of UL42 and comprising 4 copies of a target sequence for miR-125-5p.

In some embodiments, the recombinant oncolytic virus is an HSV virus comprising (i) a first miR-TS cassette comprising a plurality of miRNA target sequences inserted into a locus of ICP4; (ii) a second miR-TS cassette a plurality of miRNA target sequences inserted into a locus of UL8. In some embodiments, the first miR-TS cassette is inserted into a locus of ICP4 and comprises 1, 2, 3, or 4 copies of a target sequence for miR-124. In some embodiments, the plurality of miRNA target sequences in the second miR-TS cassettes are arranged as follows:

(a) (124-3p)-(124-3p)-(124-3p)-(124-3p).

In some embodiments, the second miR-TS cassette is inserted into a locus of UL8 and comprises 1, 2, 3, or 4 copies of a target sequence for each of miR-137, miR-208b-3p, and miR-126. In some embodiments, the plurality of miRNA target sequences in the second miR-TS cassettes are arranged as follows:

(a) (208b-3p)-(126-3p)-(137-3p)-(208b-3p)-(137-3p)-(126-3p)-(208b-3p)-(137-3p)-(126-3p)-(137-3p)-(126-3p)-(208b-3p).

In some embodiments, the recombinant oncolytic virus is an HSV virus comprising (i) a first miR-TS cassette inserted into a locus of ICP4 and comprising 4 copies of a target sequence for miR-124; (ii) a second miR-TS cassette inserted into a locus of UL8 and comprising 4 copies of a miR-137 target sequence, 4 copies of a miR-208b-3p target sequence, and 4 copies of a miR-126-3p target sequence.

In some embodiments, the recombinant oncolytic virus is an HSV virus comprising (i) a first miR-TS cassette comprising a plurality of miRNA target sequences inserted into a locus of ICP4; (ii) a second miR-TS cassette comprising a plurality of miRNA target sequences inserted into a locus of ICP27; and (iii) a third miR-TS cassette comprising a plurality of miRNA target sequences inserted into a locus of UL8. In some embodiments, the first miR-TS cassette is inserted into a locus of ICP4 and comprises 1, 2, 3, or 4 copies of a target sequence for each of miR-124, miR-1-3p, and miR-143-3p. In some embodiments, the plurality of miRNA target sequences in the first miR-TS cassette are arranged as follows:

(a) (124-3p)-(124-3p)-(124-3p)-(124-3p)-(1-3p)-(143-3p)-(1-3p)-(143-3p)-(1-3p)-(143-3p)-(1-3p)-(143-3p).

In some embodiments, the second miR-TS cassette is inserted into a locus of ICP27 and comprises 1, 2, 3, or 4 copies of a target sequence for each of miR-219a-5p, miR-122-5p, and miR-128. In some embodiments, the plurality of miRNA target sequences in the second miR-TS cassette are arranged as follows:

(a) (219a-5p)-(122-5p)-(128-3p)-(122-5p)-(219a-5p)-(128-3p)-(122-5p)
(128-3p)-(219a-5p)-(128-3p)-(122-5p)-(219a-5p).

In some embodiments, the third miR-TS cassette is inserted into a locus of UL8 and comprises 1, 2, 3, or 4 copies of a target sequence for each of miR-137, miR-208a, and miR-126. In some embodiments, the plurality of miRNA target sequences in the third miR-TS cassette are arranged as follows:

(a) (208b-3p)-(126-3p)-(137-3p)-(208b-3p)-(137-3p)-(126-3p)-(208b-3p)-(137-3p)-(126-3p)-(137-3p)-(126-3p)-(208b-3p).

In some embodiments, the recombinant oncolytic virus is an HSV virus comprising (i) a first miR-TS cassette inserted into a locus of ICP4 and comprising 4 copies of a target sequence for each of miR-124, miR-1-3p, and miR-143-3p; (ii) a second miR-TS cassette inserted into a locus of ICP27 and comprising 4 copies of a target sequence for miR-219a-5p, 4 copies of a target sequence for miR-122-5p, and 4 copies of a target sequence for miR-128; and (iii) a third miR-TS cassette inserted into a locus of UL8 and comprising 4 copies of a target sequence for miR-137, 4 copies of a target sequence for miR-208a, and 4 copies of a target sequence for miR-126.

In some embodiments, the recombinant oncolytic virus is an HSV virus comprising (i) a first miR-TS cassette comprising a plurality of miRNA target sequences inserted into a locus of ICP4; (ii) a second miR-TS cassette comprising a plurality of miRNA target sequences inserted into a locus of ICP27; (iii) a third miR-TS cassette comprising a plurality of miRNA target sequences inserted into a locus of UL8; and (iv) a fourth miR-TS cassette comprising a plurality of miRNA target sequences inserted into a locus of ICP34.5. In some embodiments, the first miR-TS cassette is inserted into a locus of ICP4 and comprises 1, 2, 3, or 4 copies of a target sequence for each of miR-124, miR-1-3p, and miR-143-3p. In some embodiments, the plurality of miRNA target sequences in the first miR-TS cassette are arranged as follows:

(a) (124-3p)-(124-3p)-(124-3p)-(124-3p)-(1-3p)-(143-3p)-(1-3p)-(143-3p)-(1-3p)-(143-3p)-(1-3p)-(143-3p).

In some embodiments, the second miR-TS cassette is inserted into a locus of ICP27 and comprises 1, 2, 3, or 4 copies of a target sequence for each of miRNA 219a-5p, miRNA 122-5p, and miRNA 128. In some embodiments, the plurality of miRNA target sequences in the second miR-TS cassette are arranged as follows:

(a) (219a-5p)-(122-5p)-(128-3p)-(122-5p)-(219a-5p)-(128-3p)-(122-5p) -(128-3p)-(219a-5p)-(128-3p)-(122-5p)-(219a-5p).

In some embodiments, the third miR-TS cassette is inserted into a locus of UL8 and comprises 1, 2, 3, or 4 copies of a target sequence for each of miR-137, miR-208a, and miR-126. In some embodiments, the plurality of miRNA target sequences in the third miR-TS cassette are arranged as follows:

(a) (208b-3p)-(126-3p)-(137-3p)-(208b-3p)-(137-3p)-(126-3p)-(208b-3p)-(137-3p)-(126-3p)-(137-3p)-(126-3p)-(208b-3p).

In some embodiments, the third miR-TS cassette is inserted into a locus of UL8 and comprises 1, 2, 3, or 4 copies of a target sequence for each of miR-137, miR-217-5p, and miR-126. In some embodiments, the plurality of miRNA target sequences in the third miR-TS cassette are arranged as follows:

(a) (137-3p)-(126-3p)-(217-5p)-(126-3p)-(217-5p)-(137-3p)-(217-5p)-(126-3p)-(137-3p)-(126-3p)-(217-5p)-(137-3p).

In some embodiments, the third miR-TS cassette is inserted into a locus of UL8 and comprises 1, 2, 3, or 4 copies of a target sequence for each of miR-137, miR-217-5p, and miR-127. In some embodiments, the plurality of miRNA target sequences in the third miR-TS cassette are arranged as follows:

(a) (137-3p)-(127-3p)-(217-5p)-(127-3p)-(217-5p)-(137-3p)-(217-5p)-(127-3p)-(137-3p)-(127-3p)-(217-5p)-(137-3p).

In some embodiments, the third miR-TS cassette is inserted into a locus of UL8 and comprises 1, 2, 3, or 4 copies of a target sequence for each of miR-137, miR-217-5p, and miR-128. In some embodiments, the plurality of miRNA target sequences in the third miR-TS cassette are arranged as follows:

(a) (137-3p)-(128-3p)-(217-5p)-(128-3p)-(217-5p)-(137-3p)-(217-5p)-(128-3p)-(137-3p)-(128-3p)-(217-5p)-(137-3p).

In some embodiments, the third miR-TS cassette is inserted into a locus of UL8 and comprises 1, 2, 3, or 4 copies of a target sequence for each of miR-137, miR-217-5p, and miR-129. In some embodiments, the plurality of miRNA target sequences in the third miR-TS cassette are arranged as follows:

(a) (137-3p)-(129-3p)-(217-5p)-(129-3p)-(217-5p)-(137-3p)-(217-5p)-(129-3p)-(137-3p)-(129-3p)-(219-5p)-(137-3p).

In some embodiments, the third miR-TS cassette is inserted into a locus of UL8 and comprises 1, 2, 3, or 4 copies of a target sequence for each of miR-137, miR-217-5p, and miR-130. In some embodiments, the plurality of miRNA target sequences in the third miR-TS cassette are arranged as follows:

(a) (137-3p)-(130-3p)-(217-5p)-(130-3p)-(217-5p)-(130-3p)-(217-5p)-(127-3p)-(137-3p)-(130-3p)-(217-5p)-(137-3p).

In some embodiments, the fourth miR-TS cassette is inserted into a locus of ICP34.5 and comprises 1, 2, 3, or 4 copies of a target sequence for each of miRNA 128M, miRNA 204, and miRNA 219-3p. In some embodiments, the plurality of miRNA target sequences in the fourth miR-TS cassette are arranged as follows:

(a) (128-3p)-(219a-5p)-(204-5p)-(128-3p)-(219a-5p)-(204-5p)-(128-3p) -(219a-5p)-(204-5p)-(128-3p)-(219a-5p)-(204-5p).

In some embodiments, the recombinant oncolytic virus is an HSV virus comprising (i) a first miR-TS cassette inserted into a locus of ICP4 and comprising four copies of a target sequence for each of miR-124, miR-1-3p, and miR-14; (ii) a second miR-TS cassette inserted into a locus of ICP27 and comprising 4 of a target sequence for each of miR-219a-5p, miR-122-5p, and miR-128; (iii) a third miR-TS cassette inserted into a locus of UL8 and comprising 4 of a target sequence for each of miR-137, miR-208b-3p, and miR-126; and (iv) a fourth miR-TS cassette inserted into a locus of ICP34.5 and comprising 4 of a target sequence for miR-128, 4 copies of a target sequence for miR-204, and 4 copies of a target sequence for miR-219-3p. In some embodiments, the recombinant oncolytic virus is an HSV virus comprising (i) a first miR-TS cassette inserted into a locus of ICP4 and comprising four copies of a target sequence for each of miR-124, miR-1-3p, and miR-14; (ii) a second miR-TS cassette inserted into a locus of ICP27 and comprising 4 of a target sequence for each of miR-219a-5p, miR-122-5p, and miR-128; and (iii) a third miR-TS cassette inserted into a locus of UL8 and comprising 4 of a target sequence for each of miR-137, miR-208a, and miR-126.

In some embodiments, the recombinant oncolytic virus is an HSV virus comprising (i) a first miR-TS cassette inserted into a locus of ICP4 and comprising four copies of a target sequence for each of miR-124, miR-1-3p, and miR-14; (ii) a second miR-TS cassette inserted into a locus of ICP27 and comprising 4 of a target sequence for each of miR-219a-5p, miR-122-5p, and miR-128; (iii) a third miR-TS cassette inserted into a locus of UL8 and comprising 4 of a target sequence for miR-137-3p, 4 of a target sequence for miR-217-5p, and 4 of a target sequence for miR-126-3p; and (iv) a fourth miR-TS cassette inserted into a locus of ICP34.5 and comprising 4 of a target sequence for miR-128, 4 copies of a target sequence for miR-204, and 4 copies of a target sequence for miR-219-3p.

In some embodiments, the recombinant oncolytic virus is an HSV virus comprising (i) a first miR-TS cassette inserted into a locus of ICP4 and comprising four copies of a target sequence for each of miR-124, miR-1-3p, and miR-14; (ii) a second miR-TS cassette inserted into a locus of ICP27 and comprising 4 of a target sequence for each of miR-219a-5p, miR-122-5p, and miR-128; (iii) a third miR-TS cassette inserted into a locus of UL8 and comprising 4 of a target sequence for miR-137-3p, 4 of a target sequence for miR-217-5p, and 4 of a target sequence for miR-127; and (iv) a fourth miR-TS cassette inserted into a locus of ICP34.5 and comprising 4 of a target sequence for miR-128, 3 copies of a target sequence for miR-204, and 3 copies of a target sequence for miR-219-5p.

In some embodiments, the recombinant oncolytic virus is an HSV virus comprising (i) a first miR-TS cassette inserted into a locus of ICP4 and comprising four copies of a target sequence for each of miR-124, miR-1-3p, and miR-14; (ii) a second miR-TS cassette inserted into a locus of ICP27 and comprising 4 of a target sequence for each of miR-219a-5p, miR-122-5p, and miR-128; (iii) a third miR-TS cassette inserted into a locus of UL8 and comprising 4 of a target sequence for miR-137-3p, 4 of a target sequence for miR-217-5p, and 4 of a target sequence for miR-128; and (iv) a fourth miR-TS cassette inserted into a locus of ICP34.5 and comprising 4 of a target sequence for miR-128, 3 copies of a target sequence for miR-204, and 3 copies of a target sequence for miR-219-5p. In some embodiments, the recombinant oncolytic virus is an HSV virus comprising (i) a first miR-TS cassette inserted into a locus of ICP4 and comprising four copies of a target sequence for each of miR-124, miR-1-3p, and miR-14; (ii) a second miR-TS cassette inserted into a locus of ICP27 and comprising 4 of a target sequence for each of miR-219a-5p, miR-122-5p, and miR-128; (iii) a third miR-TS cassette inserted into a locus of UL8 and comprising 4 of a target sequence for miR-137-3p, 4 of a target sequence for miR-217-5p, and 4 of a target sequence for miR-129; and (iv) a fourth miR-TS cassette inserted into a locus of ICP34.5 and comprising 4 of a target sequence for miR-128, 3 copies of a target sequence for miR-204, and 3 copies of a target sequence for miR-219-5p In some embodiments, the recombinant oncolytic virus is an HSV virus comprising (i) a first miR-TS cassette inserted into a locus of ICP4 and comprising four copies of a target sequence for each of miR-124, miR-1-3p, and miR-14; (ii) a second miR-TS cassette inserted into a locus of ICP27 and comprising 4 of a target sequence for each of miR-219a-5p, miR-122-5p, and miR-128; (iii) a third miR-TS cassette inserted into a locus of UL8 and comprising 4 of a target sequence for miR-137-3p, 4 of a target sequence for miR-217-5p, and 4 of a target sequence for miR-130; and (iv) a fourth miR-TS cassette inserted into a locus of ICP34.5 and comprising 4 of a target sequence for miR-128, 3 copies of a target sequence for miR-204, and 3 copies of a target sequence for miR-219-5p.

In some embodiments, the viral vectors described herein comprise one copy of a miR-125a target sequence incorporated into one essential viral gene. In some embodiments, the viral vectors described herein comprise one copy of a miR-125a target sequence incorporated into the UL42 locus. In some embodiments, the viral vectors described herein comprise one copy of a miR-122 target sequence incorporated into one essential viral gene. In some embodiments, the viral vectors described herein comprise one copy of a miR-122 target sequence incorporated into the ICP27 locus (e.g., ONCR-036).

In further embodiments, the viral vectors described herein comprise 3 copies of a miR-125a target sequence incorporated a viral gene required for viral replication. In further embodiments, the viral vectors described herein may comprise 3 copies of a miR-125a target sequence incorporated into the UL42 locus. In some embodiments, 4 copies of a miR target sequence are incorporated into the 3' UTR of an essential viral gene. In further embodiments, the viral vectors described herein may comprise 4 copies of a miR-125a target sequence incorporated into an essential viral gene. In further embodiments, the viral vectors described herein may comprise 4 copies of a miR-125a target sequence incorporated into the UL42 locus. In some embodiments, the viral vectors described herein may comprise 4 copies of a miR-122 target sequence incorporated into an essential viral gene. In further embodiments, the viral vectors described herein may comprise 4 copies of a miR-122 target sequence incorporated into the ICP27 locus (e.g., ONCR-063).

In some embodiments, 1 copy of a miR-122 target sequence is incorporated into the 3' UTR of a first essential viral gene, and 1 copy of a miR-125a target sequence is incorporated into the 3' UTR of a second essential viral gene. In some embodiments, 1 copy of a miR-122 target sequence is incorporated into the 3' UTR of the ICP27 locus, and 1 copy of a miR-125a target sequence is incorporated into the 3' UTR of the UL42 locus (e.g., ONCR-094).

In some embodiments, 1 copy of a miR-122 target sequence is incorporated into the 3' UTR of a first essential viral gene, and 3 copies of a miR-125a target sequence are incorporated into the 3' UTR of a second essential viral gene. In some embodiments, 1 copy of a miR-122 target sequence is incorporated into the 3' UTR of the ICP27 locus, and 3 copies of a miR-125a target sequence are incorporated into the 3' UTR of the UL42 locus (e.g., ONCR-095).

In some embodiments, 4 copies of a first miR target sequence are incorporated into the 3' UTR of a first essential viral gene, and 1 copy of a second miR target sequence is incorporated into the 3' UTR of a second essential viral gene. In some embodiments, 4 copies of a miR-122 target sequence are incorporated into the 3' UTR of a first essential viral gene, and 1 copy of a miR-125a target sequence is incorporated into the 3' UTR of a second essential viral gene. In some embodiments, 4 copies of a miR-122 target sequence are incorporated into the 3' UTR of the ICP27 locus, and 1 copy of a miR-125a target sequence is incorporated into the 3' UTR of the UL42 locus (e.g., ONCR-093).

In some embodiments, 4 copies of a first miR target sequence are incorporated into the 3' UTR of a first essential viral gene, and 4 copies of a second miR target sequence are incorporated into the 3' UTR of a second essential viral gene. In some embodiments, 4 copies of a miR-122 target sequence are incorporated into the 3' UTR of a first essential viral gene, and 4 copies of a miR-125a target sequence are incorporated into the 3' UTR of a second essential viral gene. In some embodiments, 4 copies of a miR-122 target sequence are incorporated into the 3' UTR of the ICP27 locus, and 4 copies of a miR-125a target sequence is incorporated into the 3' UTR of the UL42 locus (e.g., ONCR-096).

In some embodiments, the miR-attenuated oncolytic viruses described herein result in reduced viral replication in a cell that expresses a miR capable of binding to one or more of the incorporated miR-target sequences. "Viral replication" refers to the total number of viral replication cycles that occur in a particular cell or population of cells during a given amount of time. In some embodiments, viral replication can be measured directly by assessing the total viral titer present over the course of the given amount of time, or by assessing the number of viral genome copies present (e.g., by sequencing). In some embodiments, the viral vector may additionally comprise a detectable label, such as a fluorescent reporter. In such embodiments, viral replication may be assessed by measuring the fluorescence intensity of the reporter, or the number of cells that express the reporter. In some embodiments, viral replication can be measured indirectly by assessing the number of viable cells over the course of the given amount of time. For example, the level of viral replication would be expected to inversely correlate with the number of viable cells over time.

"Reduced viral replication" as used herein, refers to a level of viral replication that is lower in a first cell or first population of cells compared to a second cell or a second population of cells. In some embodiments, the level of viral replication in the first cell or first population of cells is reduced by at least 5% compared to the level of viral replication in the second cell or population of cells. In some embodiments, the level of viral replication in the first cell or first population of cells is reduced by at least 5%, 6%, 7%, 8%, 9%, 10%, 15%, 20%, 25%, 30%, 35%, 40%, 50%, 60%, 70%, 80%, 90% or more compared to the level of viral replication in the second cell or population of cells. In some embodiments, viral replication in the first cell or first population of cells is completely inhibited compared to the viral replication in the second cell or population of cells.

In some embodiments, the reduced viral replication in the first cell or first population of cells correlates with the expression of a miR capable of binding to the one or more miR-target sequences incorporated into one or more viral genes required for replication. In some embodiments, expression of a miR corresponding to the incorporated miR-target sequence therefore inhibits or reduces the expression of the replication gene, thereby inhibiting or reducing viral replication. In some embodiments, the second cell or second population of cells does not express, or has a reduced expression level, of the t miR. In some embodiments, absent or reduced expression of a miR (e.g., in a cancer cell) corresponding to the incorporated miR-target sequence allows for viral replication to proceed. In some embodiments, the expression level of the miR in the second cell or population of cells is at least 5% lower than the expression level of the miR in the first cell or population. In some embodiments, the expression level of the miR in the second cell or population of cells is reduced at least 5%, 6%, 7%, 8%, 9%, 10%, 15%, 20%, 25%, 30%, 35%, 40%, 50%, 60%, 70%, 80%, 90% or more compared to the expression level of the miR in the first cell or population. In some embodiments, the second cell does not express the miR. In particular embodiments, the first cell is a non-cancerous cell and the second cell is a cancerous cell.

In some embodiments, a replication-restricted viral vector (e.g., a miR-attenuated viral vector) comprises at least one let-7 target sequence and is used to treat lung cancer. In some embodiments, a replication-restricted viral vector comprises at least one miR-15a and/or at least one miR-16A target sequences and is used to treat B-cell chronic lymphocytic leukemia. In some embodiments, a replication-restricted viral vector comprises at least one miR-125b, at least one miR-145, at least one miR-21, and/or at least one miR-155 target sequences and is used to treat breast cancer. In other embodiments, a replication-restricted viral vector comprises at least one miR-143 and/or at least one miR-145 target sequences and is used to treat colorectal cancer. In certain embodiments, a replication-restricted viral vector comprises at least one miR-181a, at least one miR-181b, and/or at least one miR-181c target sequences and is used to treat glioblastoma. In some embodiments, a replication-restricted viral vector comprises at least one miR-199a*, at least one miR-195, at least one miR-199a, at least one miR-200a, and/or at least one miR-125a target sequences and is used to treat liver cancer (e.g., hepatocellular carcinoma).

In particular embodiments, a replication-restricted viral vector comprises at least one miR-451a target sequence, at least one miR-143-3p target sequence, at least one miR-559 target sequence, and at least one miR-124 target sequence and is used for the treatment of pancreatic, lung, and/or colon cancer. In such embodiments, the target sequences for miR-451a, miR-143-3p, miR-559, and miR-124 are incorporated into two or more genes required for viral replication (e.g., ICP4 and ICP27). In further particular embodiments, a replication-restricted viral vector comprises at least one miR-451a target sequence, at least one miR-145-5p target sequence, at least one miR-559 target sequence, and at least one miR-124 target sequence and is used for the treatment of any type of cancer described herein. In such embodiments, the target sequences for miR-451a, miR-145-5p, miR-559, and miR-124 are incorporated into two or more genes required for viral replication (e.g., ICP4 and ICP27). In further particular embodiments, a replication-restricted viral vector comprises at least one miR-205p target sequence, at least one miR-141-5p target sequence, at least one miR-31-5p target sequence, and at least one miR-124 target sequence and is used for the treatment of schwannoma. In such embodiments, the target sequences for miR-205p, miR-141-5p, miR-31-5p, and miR-124 are incorporated into two or more genes required for viral replication (e.g., ICP4 and ICP27).

In some embodiments, a recombinant oncolytic virus comprises a plurality of copies of one or more miRNA target sequences for miR-136-3p, miR-432-5p, miR-1-3p, miR-127-3p, miR-379-5p, miR-493-5p, miR-223-5p, miR-223-5p, miR-136-5p, miR-451a, miR-487b-3p, miR-370-3p, miR-410-3p, miR-431-3p, miR-4485-3p, miR-4485-5p, miR-127-5p, miR-409-3p, miR-338-3p, miR-559, miR-411-5p, miR-133a-5p, miR-143-3p, miR-376b-3p, miR-758-3p, miR-1, miR-101, miR-1180, miR-1236, miR-124-3p, miR-125b, miR-126, miR-1280, miR-133a, miR-133b, miR-141, miR-143, miR-144, miR-145, miR-155, miR-16, miR-18a, miR-192, miR-195, miR-200a, miR-200b, miR-200c, miR-203, miR-205, miR-214, miR-218, miR-23b, miR-26a, miR-29c, miR-320c, miR-34a, miR-370, miR-409-3p, miR-429, miR-451, miR-490-5p, miR-493, miR-576-3p, and/or miR-99a inserted into the 5' UTR or 3' UTR of one or more viral genes required for viral replication. This oncolytic virus may be used in methods and compositions for treating bladder cancer.

In some embodiments, a recombinant oncolytic virus comprises a plurality of copies of one or more miRNA target sequences for miR-1251-5p, miR-219a-5p, miR-219a-2-3p, miR-124-3p, miR-448, miR-138-2-3p, miR-490-5p, miR-129-1-3p, miR-1264, miR-3943, miR-490-3p, miR-383-5p, miR-133b, miR-129-2-3p, miR-128-2-5p, miR-133a-3p, miR-129-5p, miR-1-3p, miR-885-3p, miR-124-5p, miR-759, miR-7158-3p, miR-770-5p, miR-135a-5p, miR-885-5p, let-7g-5p, miR-100, miR-101, miR-106a, miR-124, miR-124a, miR-125a, miR-125a-5p, miR-125b, miR-127-3p, miR-128, miR-129, miR-136, miR-137, miR-139-5p, miR-142-3p, miR-143, miR-145, miR-146b-5p, miR-149, miR-152, miR-153, miR-195, miR-21, miR-212-3p, miR-219-5p, miR-222, miR-29b, miR-31, miR-3189-3p, miR-320, miR-320a, miR-326, miR-330, miR-331-3p, miR-340, miR-342, miR-34a, miR-376a, miR-449a, miR-483-5p, miR-503, miR-577, miR-663, miR-7, miR-7-5p, miR-873, let-7a, let-7f, miR-107, miR-122, miR-124-5p, miR-139, miR-146a, miR-146b, miR-15b, miR-16, miR-181a, miR-181a-1, miR-181a-2, miR-181b, miR-181b-1, miR-181b-2, miR-181c, miR-181d, miR-184, miR-185, miR-199a-3p, miR-200a, miR-200b, miR-203, miR-204, miR-205, miR-218, miR-23b, miR-26b, miR-27a, miR-29c, miR-328, miR-34c-3p, miR-34c-5p, miR-375, miR-383, miR-451, miR-452, miR-495, miR-584, miR-622, miR-656, miR-98, miR-124-3p, miR-181b-5p, miR-200b, and/or miR-3189-3p inserted into the 5' UTR or 3' UTR of one or more viral genes required for viral replication. This oncolytic virus may be used in methods and compositions for treating brain cancer. In certain embodiments, the brain cancer is astrocytoma, glioblastoma, or glioma.

In some embodiments, a recombinant oncolytic virus comprises a plurality of copies of one or more miRNA target sequences for miR-10b-5p, miR-126-3p, miR-145-3p, miR-451a, miR-199b-5p, miR-5683, miR-3195, miR-3182, miR-1271-5p, miR-204-5p, miR-409-5p, miR-136-5p, miR-514a-5p, miR-559, miR-483-3p, miR-1-3p, miR-6080, miR-144-3p, miR-10b-3p, miR-6130, miR-6089, miR-203b-5p, miR-4266, miR-4327, miR-5694, miR-193b, let-7a, let-7a-1, let-7a-2, let-7a-3, let-7b, let-7c, let-7d, let-7e, let-7f-1, let-7f-2, let-7g, let-7i, miR-100, miR-107, miR-10a, miR-10b, miR-122, miR-124, miR-1258, miR-125a-5p, miR-125b, miR-126, miR-127, miR-129, miR-130a, miR-132, miR-133a, miR-143, miR-145, miR-146a, miR-146b, miR-147, miR-148a, miR-149, miR-152, miR-153, miR-15a, miR-16, miR-17-5p, miR-181a, miR-1826, miR-183, miR-185, miR-191, miR-193a-3p, miR-195, miR-199b-5p, miR-19a-3p, miR-200a, miR-200b, miR-200c, miR-205, miR-206, miR-211, miR-216b, miR-218, miR-22, miR-26a, miR-26b, miR-300, miR-30a, miR-31, miR-335, miR-339-5p, miR-33b, miR-34a, miR-34b, miR-34c, miR-374a, miR-379, miR-381, miR-383, miR-425, miR-429, miR-450b-3p, miR-494, miR-495, miR-497, miR-502-5p, miR-517a, miR-574-3p, miR-638, miR-7, miR-720, miR-873, miR-874, miR-92a, miR-98, miR-99a, mmu-miR-290-3p, and/or mmu-miR-290-5p inserted into the 5' UTR or 3' UTR of one or more viral genes required for viral replication. This oncolytic virus may be used in methods and compositions for treating breast cancer.

In some embodiments, a recombinant oncolytic virus comprises a plurality of copies of one or more miRNA target sequences for miR-143, miR-145, miR-17-5p, miR-203, miR-214, miR-218, miR-335, miR-342-3p, miR-372, miR-424, miR-491-5p, miR-497, miR-7, miR-99a, miR-99b, miR-100, miR-101, miR-15a, miR-16, miR-34a, miR-886-5p, miR-106a, miR-124, miR-148a, miR-29a, and/or miR-375 inserted into the 5' UTR or 3' UTR of one or more viral genes required for viral replication. This oncolytic virus may be used in methods and compositions for treating cervical cancer.

In some embodiments, a recombinant oncolytic virus comprises a plurality of copies of one or more miRNA target sequences for miR-133a-5p, miR-490-5p, miR-124-3p, miR-137, miR-655-3p, miR-376c-3p, miR-369-5p, miR-490-3p, miR-432-5p, miR-487b-3p, miR-342-3p, miR-223-3p, miR-136-3p, miR-136-3p, miR-143-5p, miR-1-3p, miR-214-3p, miR-143-3p, miR-199a-3p, miR-199b-3p, miR-451a, miR-127-3p, miR-133a-3p, miR-145-5p, miR-145-3p, miR-199a-5p, let-7a-1, let-7a-2, let-7a-3, let-7b, let-7c, let-7d, let-7e, let-7f-1, let-7f-2, let-7g, let-7i, miR-100, miR-101, miR-126, miR-142-3p, miR-143, miR-145, miR-192, miR-200c, miR-21, miR-214, miR-215, miR-22, miR-25, miR-302a, miR-320, miR-320a, miR-34a, miR-34c, miR-365, miR-373, miR-424, miR-429, miR-455, miR-484, miR-502, miR-503, miR-93, miR-98, miR-186, miR-30a-5p, miR-627, let-7a, miR-1, miR-124, miR-125a, miR-129, miR-1295b-3p, miR-1307, miR-130b, miR-132, miR-133a, miR-133b, miR-137, miR-138, miR-139, miR-139-5p, miR-140-5p, miR-148a, miR-148b, miR-149, miR-150-5p, miR-154, miR-15a, miR-15b, miR-16, miR-18a, miR-191, miR-193a-5p, miR-194, miR-195, miR-196a, miR-198, miR-199a-5p, miR-203, miR-204-5p, miR-206, miR-212, miR-218, miR-224, miR-24-3p, miR-26b, miR-27a, miR-28-3p, miR-28-5p, miR-29b, miR-30a-3p, miR-30b, miR-328, miR-338-3p, miR-342, miR-345, miR-34a-5p, miR-361-5p, miR-375, miR-378, miR-378a-3p, miR-378a-5p, miR-409-3p, miR-422a, miR-4487, miR-483, miR-497, miR-498, miR-518a-3p, miR-551a, miR-574-5p, miR-625, miR-638, miR-7, miR-96-5p, miR-202-3p, miR-30a, and/or miR-451 inserted into the 5' UTR or 3' UTR of one or more viral genes required for viral replication. This oncolytic virus may be used in methods and compositions for treating colon or colorectal cancer.

In some embodiments, a recombinant oncolytic virus comprises a plurality of copies of one or more miRNA target sequences for miR-101, miR-130a, miR-130b, miR-134, miR-143, miR-145, miR-152, miR-205, miR-223, miR-301a, miR-301b, miR-30c, miR-34a, miR-34c, miR-424, miR-449a, miR-543, and/or miR-34b inserted into the 5' UTR or 3' UTR of one or more viral genes required for viral replication. This oncolytic virus may be used in methods and compositions for treating endometrial cancer.

In some embodiments, a recombinant oncolytic virus comprises a plurality of copies of one or more miRNA target sequences for miR-125b, miR-138, miR-15a, miR-15b, miR-16, miR-16-1, miR-16-1-3p, miR-16-2, miR-181a, miR-181b, miR-195, miR-223, miR-29b, miR-34b, miR-34c, miR-424, miR-10a, miR-146a, miR-150, miR-151, miR-155, miR-2278, miR-26a, miR-30e, miR-31, miR-326, miR-564, miR-27a, let-7b, miR-124a, miR-142-3p, let-7c, miR-17, miR-20a, miR-29a, miR-30c, miR-720, miR-107, miR-342, miR-34a, miR-202, miR-142-5p, miR-29c, miR-145, miR-193b, miR-199a, miR-214, miR-22, miR-137, and/or miR-197 inserted into the 5' UTR or 3' UTR of one or more viral genes required for viral replication. This oncolytic virus may be used in methods and compositions for treating hematologic cancer. In some embodiments, the hematologic cancer is leukemia, lymphoma, or myeloma.

In some embodiments, a recombinant oncolytic virus comprises a plurality of copies of one or more miRNA target sequences for miR-1, miR-145, miR-1826, miR-199a, miR-199a-3p, miR-203, miR-205, miR-497, miR-508-3p, miR-509-3p, let-7a, let-7d, miR-106a*, miR-126, miR-1285, miR-129-3p, miR-1291, miR-133a, miR-135a, miR-138, miR-141, miR-143, miR-182-5p, miR-200a, miR-218, miR-28-5p, miR-30a, miR-30c, miR-30d, miR-34a, miR-378, miR-429, miR-509-5p, miR-646, miR-133b, let-7b, let-7c, miR-200c, miR-204, miR-335, miR-377, and/or miR-506 inserted into the 5' UTR or 3' UTR of one or more viral genes required for viral replication. This oncolytic virus may be used in methods and compositions for treating kidney cancer.

In some embodiments, a recombinant oncolytic virus comprises a plurality of copies of one or more miRNA target sequences for let-7a-1, let-7a-2, let-7a-3, let-7b, let-7c, let-7d, let-7e, let-7f, let-7f-1, let-7f-2, let-7g, let-7i, miR-1, miR-100, miR-101, miR-105, miR-122, miR-122a, miR-1236, miR-124, miR-125b, miR-126, miR-127, miR-1271, miR-128-3p, miR-129-5p, miR-130a, miR-130b, miR-133a, miR-134, miR-137, miR-138, miR-139, miR-139-5p, miR-140-5p, miR-141, miR-142-3p, miR-143, miR-144, miR-145, miR-146a, miR-148a, miR-148b, miR-150-5p, miR-15b, miR-16, miR-181a-5p, miR-185, miR-188-5p, miR-193b, miR-195, miR-195-5p, miR-197, miR-198, miR-199a, miR-199a-5p, miR-199b, miR-199b-5p, miR-200a, miR-200b, miR-200c, miR-202, miR-203, miR-204-3p, miR-205, miR-206, miR-20a, miR-21, miR-21-3p, miR-211, miR-212, miR-214, miR-217, miR-218, miR-219-5p, miR-22, miR-223, miR-26a, miR-26b, miR-29a, miR-29b-1, miR-29b-2, miR-29c, miR-302b, miR-302c, miR-30a, miR-30a-3p, miR-335, miR-338-3p, miR-33a, miR-34a, miR-34b, miR-365, miR-370, miR-372, miR-375, miR-376a, miR-377, miR-422a, miR-424, miR-424-5p, miR-433, miR-4458, miR-448, miR-450a, miR-451, miR-485-5p, miR-486-5p, miR-497, miR-503, miR-506, miR-519d, miR-520a, miR-520b, miR-520c-3p, miR-582-5p, miR-590-5p, miR-610, miR-612, miR-625, miR-637, miR-675, miR-7, miR-877, miR-940, miR-941, miR-98, miR-99a, miR-132, and/or miR-31 inserted into the 5' UTR or 3' UTR of one or more viral genes required for viral replication. This oncolytic virus may be used in methods and compositions for treating liver cancer. In some embodiments, the liver cancer is hepatocellular carcinoma.

In some embodiments, a recombinant oncolytic virus comprises a plurality of copies of one or more miRNA target sequences for miR-143-3p, miR-126-3p, miR-126-5p, miR-1266-3p, miR-6130, miR-6080, miR-511-5p, miR-143-5p, miR-223-5p, miR-199b-5p, miR-199a-3p, miR-199b-3p, miR-451a, miR-142-5p, miR-144, miR-150-5p, miR-142-3p, miR-214-3p, miR-214-5p, miR-199a-5p, miR-145-3p, miR-145-5p, miR-1297, miR-141, miR-145, miR-16, miR-200a, miR-200b, miR-200c, miR-29b, miR-381, miR-409-3p, miR-429, miR-451, miR-511, miR-99a, let-7a-1, let-7a-2, let-7a-3, let-7b, let-7c, let-7d, let-7e, let-7f-1, let-7f-2, let-7g, let-7i, miR-1, miR-101, miR-133b, miR-138, miR-142-5p, miR-144, miR-1469, miR-146a, miR-153, miR-15a, miR-15b, miR-16-1, miR-16-2, miR-182, miR-192, miR-193a-3p, miR-194, miR-195, miR-198, miR-203, miR-217, miR-218, miR-22, miR-223, miR-26a, miR-26b, miR-29c, miR-33a, miR-34a, miR-34b, miR-34c, miR-365, miR-449a, miR-449b, miR-486-5p, miR-545, miR-610, miR-614, miR-630, miR-660, miR-7515, miR-9500, miR-98, miR-99b, miR-133a, let-7a, miR-100, miR-106a, miR-107, miR-124, miR-125a-3p, miR-125a-5p, miR-126, miR-126*, miR-129, miR-137, miR-140, miR-143, miR-146b, miR-148a, miR-148b, miR-149, miR-152, miR-154, miR-155, miR-17-5p, miR-181a-1, miR-181a-2, miR-181b, miR-181b-1, miR-181b-2, miR-181c, miR-181d, miR-184, miR-186, miR-193b, miR-199a, miR-204, miR-212, miR-221, miR-224, miR-27a, miR-27b, miR-29a, miR-30a, miR-30b, miR-30c, miR-30d, miR-30d-5p, miR-30e-5p, miR-32, miR-335, miR-338-3p, miR-340, miR-342-3p, miR-361-3p, miR-373, miR-375, miR-4500, miR-4782-3p, miR-497, miR-503, miR-512-3p, miR-520a-3p, miR-526b, miR-625*, and/or miR-96 inserted into the 5' UTR or 3' UTR of one or more viral genes required for viral replication. This oncolytic virus may be used in methods and compositions for treating lung cancer.

In some embodiments, a recombinant oncolytic virus comprises a plurality of copies of one or more miRNA target sequences for let-7b, miR-101, miR-125b, miR-1280, miR-143, miR-146a, miR-146b, miR-155, miR-17, miR-184, miR-185, miR-18b, miR-193b, miR-200c, miR-203, miR-204, miR-205, miR-206, miR-20a, miR-211, miR-218, miR-26a, miR-31, miR-33a, miR-34a, miR-34c, miR-376a, miR-376c, miR-573, miR-7-5p, miR-9, and/or miR-98 inserted into the 5' UTR or 3' UTR of one or more viral genes required for viral replication. This oncolytic virus may be used in methods and compositions for treating melanoma.

In some embodiments, a recombinant oncolytic virus comprises a plurality of copies of one or more miRNA target sequences for let-7d, miR-218, miR-34a, miR-375, miR-494, miR-100, miR-124, miR-1250, miR-125b, miR-126, miR-1271, miR-136, miR-138, miR-145, miR-147, miR-148a, miR-181a, miR-206, miR-220a, miR-26a, miR-26b, miR-29a, miR-32, miR-323-5p, miR-329, miR-338, miR-370, miR-410, miR-429, miR-433, miR-499a-5p, miR-503, miR-506, miR-632, miR-646, miR-668, miR-877, and/or miR-9 inserted into the 5' UTR or 3' UTR of one or more viral genes required for viral replication. This oncolytic virus may be used in methods and compositions for treating oral cancer.

In some embodiments, a recombinant oncolytic virus comprises a plurality of copies of one or more miRNA target sequences for let-7i, miR-100, miR-124, miR-125b, miR-129-5p, miR-130b, miR-133a, miR-137, miR-138, miR-141, miR-145, miR-148a, miR-152, miR-153, miR-155, miR-199a, miR-200a, miR-200b, miR-200c, miR-212, miR-335, miR-34a, miR-34b, miR-34c, miR-409-3p, miR-411, miR-429, miR-432, miR-449a, miR-494, miR-497, miR-498, miR-519d, miR-655, miR-9, miR-98, miR-101, miR-532-5p, miR-124a, miR-192, miR-193a, and/or miR-7 inserted into the 5' UTR or 3' UTR of one or more viral genes required for viral replication. This oncolytic virus may be used in methods and compositions for treating ovarian cancer.

In some embodiments, a recombinant oncolytic virus comprises a plurality of copies of one or more miRNA target sequences for miR-216a-5p, miR-802, miR-217, miR-145-3p, miR-143-3p, miR-451a, miR-375, miR-214-3p, miR-216b-3p, miR-432-5p, miR-216a-3p, miR-199b-5p, miR-199a-5p, miR-136-3p, miR-216b-5p, miR-136-5p, miR-145-5p, miR-127-3p, miR-199a-3p, miR-199b-3p, miR-559, miR-129-2-3p, miR-4507, miR-1-3p, miR-148a-3p, miR-101, miR-1181, miR-124, miR-1247, miR-133a, miR-141, miR-145, miR-146a, miR-148a, miR-148b, miR-150*, miR-150-5p, miR-152, miR-15a, miR-198, miR-203, miR-214, miR-216a, miR-29c, miR-335, miR-34a, miR-34b, miR-34c, miR-373, miR-375, miR-410, miR-497, miR-615-5p, miR-630, miR-96, miR-132, let-7a, let-7a-1, let-7a-2, let-7a-3, let-7b, let-7c, let-7d, let-7e, let-7f-1, let-7f-2, let-7g, let-7i, miR-126, miR-135a, miR-143, miR-144, miR-150, miR-16, miR-200a, miR-200b, miR-200c, miR-217, miR-218, miR-337, miR-494, and/or miR-98 inserted into the 5' UTR or 3' UTR of one or more viral genes required for viral replication. This oncolytic virus may be used in methods and compositions for treating pancreatic cancer.

In some embodiments, a recombinant oncolytic virus comprises a plurality of copies of one or more miRNA target sequences for let-7a-3p, let-7c, miR-100, miR-101, miR-105, miR-124, miR-128, miR-1296, miR-130b, miR-133a-1, miR-133a-2, miR-133b, miR-135a, miR-143, miR-145, miR-146a, miR-154, miR-15a, miR-187, miR-188-5p, miR-199b, miR-200b, miR-203, miR-205, miR-212, miR-218, miR-221, miR-224, miR-23a, miR-23b, miR-25, miR-26a, miR-26b, miR-29b, miR-302a, miR-30a, miR-30b, miR-30c-1, miR-30c-2, miR-30d, miR-30e, miR-31, miR-330, miR-331-3p, miR-34a, miR-34b, miR-34c, miR-374b, miR-449a, miR-4723-5p, miR-497, miR-628-5p, miR-642a-5p, miR-765, and/or miR-940 inserted into the 5' UTR or 3' UTR of one or more viral genes required for viral replication. This oncolytic virus may be used in methods and compositions for treating prostate cancer.

In some embodiments, a recombinant oncolytic virus comprises a plurality of copies of one or more miRNA target sequences for miR-101, miR-183, miR-204, miR-34a, miR-365b-3p, miR-486-3p, and/or miR-532-5p inserted into the 5' UTR or 3' UTR of one or more viral genes required for viral replication. This oncolytic virus may be used in methods and compositions for treating retinoblastoma.

In some embodiments, an oncolytic virus described herein is a herpes simplex virus and wherein the one or more viral genes required for viral replication is selected from the group consisting of UL1, UL5, UL6, UL7, UL8, UL9, UL11, UL12, UL14, UL15, UL17, UL18, UL19, UL20, UL22, UL25, UL26, UL26.5, UL27, UL28, UL29, UL30, UL31, UL32, UL33, UL34, UL35, UL36, UL37, UL38, UL39, UL40, UL42, UL48, UL49, UL52, UL53, UL54, ICP0, ICP4, ICP22, ICP27, ICP47, gamma-34.5, US3, US4, US5, US6, US7, US8, US9, US10, US11, and US12.

Payload Molecules

In some embodiments, the oncolytic viruses described herein comprise a nucleic acid sequence encoding a payload molecule. As used herein, a "payload molecule" refers to a molecule capable of further enhancing the therapeutic efficacy of a virus. Payload molecules suitable for use in the present disclosure include antigen-binding molecules such as antibodies or antigen binding fragments thereof, cytokines, chemokines, soluble receptors, cell-surface receptor ligands, bipartite peptides, enzymes, and nucleic acids (e.g., shRNAs, siRNAs, antisense RNAs, antagomirs, ribozymes, apatamers, a decoy oligonucleotide, or an antagomir). The nature of the payload molecule will vary with the disease type and desired therapeutic outcome. In some embodiments, one or more miRNA target sequences is incorporated in to the 3' or 5' UTR of a polynucleotide sequence encoding a payload molecule. In such embodiments, translation and subsequent expression of the payload does not occur, or is substantially reduced, in cells where the corresponding miRNA is expressed. In some embodiments, one or more miRNA target sequences are inserted into the 3' and/or 5' UTR of the polynucleotide sequence encoding the therapeutic polypeptide.

In some embodiments, the recombinant oncolytic viruses described herein comprise at least one polynucleotide encoding a payload molecule that that reduces the expression or inhibits the function of an endogenous miRNA, a gene, or a tissue inhibitor of metalloproteinases (TIMP). Such recombinant oncolytic viruses are referred to herein as "genome-editing" or "microenvironment-remodeling" viruses or vectors. The encoded protein or oligonucleotide may reduce expression or inhibit the function of a miRNA, gene, or TIMP in any number of ways including targeting the protein (e.g., a TIMP) for degradation (e.g., by ubiquitination and proteosomal degradation or targeting for lysosomal degradation), blocking interactions with cognate receptors (e.g., blocking antibodies or antigen binding fragments thereof or peptide inhibitors), degrading messenger RNA transcripts (e.g., a short interfering RNA or short hairpin RNA), and/or altering the genomic DNA sequence encoding the specific miRNA, gene, or protein (e.g., by an endonuclease).

In particular embodiments, the protein or oligonucleotide reduces the expression of a miR or a gene involved in carcinogenesis or metastasis (e.g., an oncogenic miR or an oncogene). In some embodiments, a recombinant oncolytic virus comprises at least one polynucleotide encoding a payload molecule that reduces the expression or function of a miRNA that is an oncogenic miRNA (e.g., one or more of the miRNAs listed in Table 4). In some embodiments, the recombinant oncolytic virus comprises at least 1, 2, 3, 4, 5, 6, 7, 8, 9, 10 or more polynucleotides encoding for a protein or oligonucleotide that reduces the expression or function of an oncogenic miRNA. In some embodiments, the recombinant oncolytic virus comprises at least 1, 2, 3, 4, 5, 6, 7, 8, 9, 10 or more polynucleotides encoding for a plurality of proteins or oligonucleotides that reduce the expression or function of a plurality of oncogenic miRNAs. In some embodiments, the protein or oligonucleotide reduces the expression of miR-17-92 and is used to treat lung cancer (e.g., small-cell lung cancer). In other embodiments, the protein or oligonucleotide reduces the expression of miR-221 and/or miR-21 and is used to treat glioblastoma. In certain embodiments, the protein or oligonucleotide reduces the expression of miR-155 and/or miR-17-92 and is used to treat lymphoma (e.g., Burkitt's lymphoma, diffuse large B cell lymphoma, marginal zone lymphoma, or chronic lymphocytic leukemia). In some embodiments, the protein or oligonucleotide reduces the expression of miR-221, miR-222, and/or miR-146 and is used to treat thyroid cancer. In some embodiments, the protein or oligonucleotide reduces the expression of miR-372 and/or miR-373 and is used to treat testicular cancer (e.g., testicular germ cell tumors). In some embodiments, the protein or oligonucleotide reduces the expression of miR-18 and/or miR-224 and is used to treat liver cancer (e.g., hepatocellular carcinoma).

In some embodiments, a recombinant viral vectors described herein comprise a polynucleotide encoding a payload molecule that degrades the tumor extracellular matrix (ECM), which in some aspects leads to enhanced viral spread. Matrix metalloproteinases (MMPs) are zinc-dependent proteases that are classified, based on their activity, into collagenases, gelatinases, stromelysins and matrilysins. These proteases are generally secreted as pro-enzymes (zymogens) and are activated by proteolytic removal of the pro-peptide pro-domain. The primary role that MMPs play in cancer is in the degradation of the ECM, which facilitates tumor invasion and metastasis. MMPs are also involved in tumor progression, epithelial to mesenchymal transition (EMT), and angiogenesis. MMPs are regulated by miRs as well as TIMPs, which comprise a family of four protease inhibitors (TIMP1, TIMP2, TIMP3, and TIMP4). A broad array of tumor microenvironments can be degraded by disrupting miRNAs or TIMPs that negatively regulate the MMP family with the recombinant viral vectors of the invention. Examples of miR/MMP interactions are shown in Table 5. Many of these interactions show that multiple MMPs are regulated by a single miRNA: e.g. let-7 regulates MMP-2, MMP-9, and MMP-14; miR-143 regulates MMP-2, MMP-9, and MMP-13; miR-218 regulates MMP-2, MMP-7, and MMP-9. Furthermore, the vast majority of MMPs may be regulated by a single TIMP master switch: e.g. TIMP1 is known to inhibit most all of the known MMPs and also promotes cell proliferation in a wide range of cell types; TIMP2 interacts with MMP-14 and MMP-2.

In some embodiments, the recombinant oncolytic viruses described herein comprise at least one polynucleotide encoding a protein or an oligonucleotide that reduces the expression or function of a miRNA that is capable of altering the extracellular matrix or capable of modulating a pathway that alters the extracellular matrix, particularly in a tumor microenvironment (e.g., one or more of the miRNAs listed in Table 5). A microenvironment remodeling miR, as used herein, refers to a miR. In some embodiments, the protein or oligonucleotide reduces the expression or function of one microenvironment remodeling miR. In some embodiments, the protein or oligonucleotide reduces the expression or function of at least 2, 3, 4, 5, 6, 7, 8, 9, or 10 or more microenvironment remodeling miRs. In some embodiments, the recombinant oncolytic virus comprises a plurality of polynucleotides encoding a plurality of protein or oligonucleotides that reduce the expression or function of a plurality of microenvironment remodeling miRs. In some embodiments, strategies described herein may be utilized by recombinant viral vectors of the present invention to knock-down or disrupt expression or function of miRs or TIMPs which negatively regulate MMPs. In some embodiments, a recombinant oncolytic virus reduces the expression of a TIMP selected from TIMP1, TIMP2, TIMP3 and TIMP4.

In some embodiments, the recombinant oncolytic viruses described herein comprise at least one polynucleotide encoding a protein or an oligonucleotide that reduces the expression or function of a gene in the host cell genome. In some aspects, the gene is an oncogenic gene (e.g., a gene selected from the genes listed in Table 7). In some aspects, the gene encodes an oncogenic miR (e.g., a miRNA listed in Table 4), a microenvironment remodeling miR (e.g., a miRNA listed in Table 5), or a negative regulator of ECM-degradation (e.g., a TIMP). Reduction of gene expression and/or function may be accomplished by at the level of transcription (e.g., mutating, deleting, or silencing the genomic DNA sequence) or at the level of translation (e.g., by inhibiting the production of the gene product through mRNA degradation). In some embodiments, the recombinant oncolytic viruses described herein comprise one or more polynucleotides that encode for nucleases that reduce the expression or function of a gene by enabling the mutation, deletion, or repression of transcription of a gene sequence. In specific embodiments, the nuclease is selected from a Clustered Regulatory Interspaced Short Palindromic Repeats (CRISPR)-associated endonuclease, a zinc-finger nuclease (ZFN) or a Transcription activator-like effector nuclease (TALEN). In non-limiting examples, a CRISPR-associated endonuclease is selected from SpCas9, SpCas9-HF1, SpCas9-HF2, SpCas9-HF3, SpCas9-HF4, SaCas9, FnCpf, FnCas9, eSpCas9, C2C1, C2C2, C2C3, Cpf1, Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, and Csf4.

Recombinant viral vectors of the invention may utilize the CRISPR (Clustered Regularly Interspaced Short Palindromic Repeats)/Cas (CRISPR Associated) nuclease system, which is an engineered nuclease system based on a bacterial system that can be used for mammalian genome engineering. Generally, the system comprises a Cas nuclease and a guide RNA (gRNA). The gRNA is comprised of two parts; a crispr-RNA (crRNA) that is specific for a target genomic DNA sequence, and a tracr RNA (trRNA) that facilitates Cas binding. The crRNA and trRNA may be present as separate RNA oligonucleotides, or may be present in the same RNA oligonucleotide, referred to as a single guide-RNA (sgRNA). As used herein, the term "guide RNA" or "gRNA" refers to either the combination of an individual trRNA and an individual crRNA or an sgRNA. See, e.g., Jinek et al. (2012) *Science* 337:816-821; Cong et al. (2013) *Science* 339:819-823; Mali et al. (2013) *Science* 339:823-826; Qi et al. (2013) *Cell* 152:1173-1183; Jinek et al. (2013), *eLife* 2: e00471; David Segal (2013) *eLife* 2: e00563; Ran et al. (2013) *Nature Protocols* 8 (11): 2281-2308; Zetsche et al. (2015) *Cell* 163 (3): 759-771; PCT Publication Nos. WO 2007/025097, WO 2008/021207, WO 2010/011961, WO 2010/054108, WO 2010/054154, WO 2012/054726, WO 2012/149470, WO 2012/164565, WO 2013/098244, WO 2013/126794, WO 2013/141680, and WO 2013/142578; U.S. Patent Publication Nos. 2010-0093617, 2013-0011828, 2010-0257638, 2010-0076057, 2011-0217739, 2011-0300538, 2013-0288251, and 2012-0277120; and U.S. Pat. No. 8,546,553, each of which is incorporated herein by reference in its entirety.

Multiple class 1 CRISPR-Cas systems, which include the type I and type III systems, have been identified and functionally characterized in detail, revealing the complex architecture and dynamics of the effector complexes (Brouns et al., 2008, Marraffini and Sontheimer, 2008, Hale et al., 2009, Sinkunas et al., 2013, Jackson et al., 2014, Mulepati et al., 2014). In addition, several class 2-type II CRISPR-Cas systems that employ homologous RNA-guided endonucleases of the Cas9 family as effectors have also been identified and experimentally characterized (Barrangou et al., 2007, Garneau et al., 2010, Deltcheva et al., 2011, Sapranauskas et al., 2011, Jinek et al., 2012, Gasiunas et al., 2012). A second, putative class 2-type V CRISPR-Cas system has been recently identified in several bacterial genomes. The putative type V CRISPR-Cas systems contain a large, ~1,300 amino acid protein called Cpf1 (CRISPR from Prevotella and Francisella 1).

Figure 39:
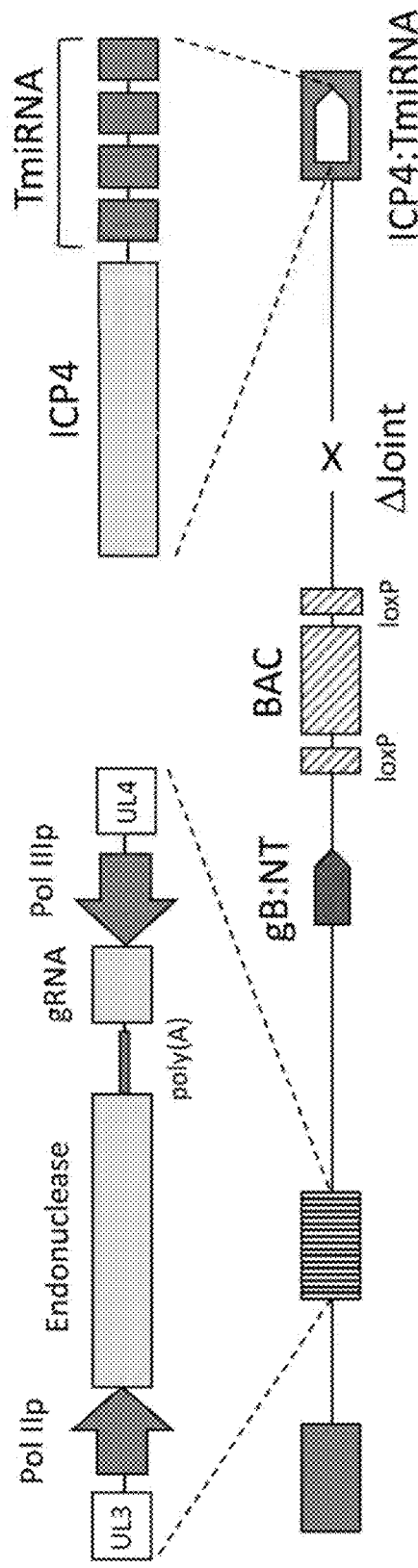
FIG. 39 shows a schematic of an ICP4-TmiRNA-attenuated, genome-editing HSV vector for the treatment of cancer. gB:NT: virus entry-enhancing double mutation in gB gene; BAC: loxP-flanked choramphenicol-resistance and lacZ sequences; Δjoint: deletion of the complete internal repeat region including one copy of the ICP4 gene; ICP4:TmiRNA: insertion of miRNA target sequences (e.g. let-7, miR-34a, miR-101, miR-125b, miR-145) in the 3' UTR of the remaining ICP4 gene (also may be placed in 5' UTR); Pol II promoter: Constitutive (CAG, UbC, EF1a, PGK) or cell-specific (e.g. TRPV1, Nav1.7, hSYN); Endonuclease.

In some embodiments, an oncolytic virus described herein further comprises at least one polynucleotide encoding a trRNA and crRNA targeted to the miRNA or the TIMP. In some cases, the at least one polynucleotide encoding a trRNA and crRNA is inserted into a locus on the viral genome. In some embodiments, the polynucleotide is an insulated sequence comprising a synthetic insulator or a native viral (e.g., HSV) insulator. In certain embodiments, an oncolytic virus is a herpes simplex virus and the at least one polynucleotide encoding an RNA binding site is inserted into or between one or more loci including the internal repeat joint region (comprising one copy each of the diploid genes ICP0, ICP34.5, LAT, ICP4, and the ICP47 promoter), ICP0, LAT, UL1, UL5, UL6, UL7, UL8, UL9, UL11, UL12, UL14, UL15, UL17, UL18, UL19, UL20, UL22, UL25, UL26, UL26.5, UL27, UL28, UL29, UL30, UL31, UL32, UL33, UL34, UL35, UL36, UL37, UL38, UL39, UL40, UL42, UL48, UL49, UL52, UL53, UL54, ICP0, ICP4, ICP22, ICP27, ICP47, gamma-34.5, US3, US4, US5, US6, US7, US8, US9, US10, US11, and US12. In one embodiment, an oncolytic virus is a herpes simplex virus (HSV) and the at least one polynucleotide encoding an RNA binding site is inserted into a locus between the UL3 and the UL4 open reading frames (e.g., FIG. 39 and FIG. 40).

In some embodiments, the recombinant oncolytic virus comprises at least one polynucleotide encoding a payload molecule that activate or enhances an anti-tumor immune response. In some embodiments, the payload molecule is a cytokine, a chemokine, an antibody or antigen binding fragment thereof, a bispecific T-cell engager (BiTE). For example, in some embodiments, the payload molecule is an antibody or antigen binding fragments thereof that bind to and inhibit immune checkpoint receptors (e.g. CTLA4, LAG3, PD1, PDL1, and others). In some embodiments, the payload molecule is an anti-PD1 antibody or antigen-binding fragment thereof, an anti-PDL1 antibody or antigen-binding fragment thereof, or an anti-CTLA4 antibody or antigen-binding fragment thereof.

In some embodiments, the payload molecule is a protein that binds to and activates a cell-surface receptor. For example, in some embodiments, payload molecule comprises an endogenous cell-surface ligand, such as the extracellular domain of 41BBL, the extracellular domain of CD40L, FLT3L. In some embodiments, the payload molecule is a cytokine (e.g., IFNγ, IFNα, IFNβ, TNFα, IL-12, IL-2, IL-6, IL-8, IL-15, GM-CSF, IL-21, IL-35, TGFβ, and others) or chemokine (e.g., CCL4, CXCL10, CCL5, CXCL13, or XCL1).

In some embodiments, the payload molecule is a protein that binding to and activate an activating receptor (e.g., FcγRI, FcγIIa, FcγIIIa, costimulatory receptors, and others). In particular embodiments, the protein is selected from EpCAM, folate, A2A, anti-FGF2, anti-FGFR/FGFR2b, anti-SEMA4D, CD137, CD200, CD38, CD44, CSF-1R, endothelin B Receptor, ISRE7, LFA-1, NG2 (also known as SPEG4), SMADs, STING, and VCAM1.

In certain embodiments, a polynucleotide encoding a protein or an oligonucleotide targeted to reduce expression of an miRNA, a gene, or a TIMP is inserted into a locus on the viral genome of a recombinant oncolytic virus. In some embodiments, the polynucleotide is an insulated sequence comprising a synthetic insulator or a native viral (e.g., HSV) insulator. In certain embodiments, the oncolytic virus is a herpes simplex virus and the at least one polynucleotide encoding an RNA binding site is inserted into or between one or more loci including the internal repeat joint region (comprising one copy each of the diploid genes ICP0, ICP34.5, LAT, ICP4, and the ICP47 promoter), ICP0, LAT, UL1, UL5, UL6, UL7, UL8, UL9, UL11, UL12, UL14, UL15, UL17, UL18, UL19, UL20, UL22, UL25, UL26, UL26.5, UL27, UL28, UL29, UL30, UL31, UL32, UL33, UL34, UL35, UL36, UL37, UL38, UL39, UL40, UL42, UL48, UL49, UL52, UL53, UL54, ICP0, ICP4, ICP22, ICP27, ICP47, gamma-34.5, US3, US4, US5, US6, US7, US8, US9, US10, US11, and US12 . . . . In one embodiment, the virus is a herpes simplex virus (HSV) and the at least one polynucleotide is inserted into a locus between the UL3 and the UL4 open reading frames (see, e.g., FIG. 39 and FIG. 40).

In some embodiments, the recombinant oncolytic virus comprises at least one protease-activated antibody. Protease-activated antibodies, such as those described by Metz et al. (Protein Eng Des Sel, 25 (10): 571-80, 2012) are activated and bind only to targets following protease cleavage of a protective cap. In some instances, tumor microenvironments possess an array of proteases that are well differentiated from surrounding healthy tissues. For example, the protease cathepsin B is overexpressed in numerous cancers, including breast, cervix, colon, colorectal, gastric, head and neck, liver, lung, melanoma, ovarian, pancreatic, prostate, and thyroid cancer. The human degradome, comprised of a complete list of proteases synthesized by human cells, is made up of at least 569 proteases that are distributed into five broad classes (in order from greatest to least number): metalloproteinases (MMPs), serine, cysteine, threonine, and aspartic proteases (Lopez-Otin et al., Nat Rev Cancer, 7 (10): 800-8, 2007). In particular, protease antibodies specifically cleaved by MMPs can serve as an excellent means of targeting the recombinant viral vectors described herein to the tumor microenvironment, as MMPs are found in the extracellular and pericellular areas of the cell. Table 6 summarizes proteases that are overexpressed in cancers which can be exploited to enable specific binding of recombinant viral vectors pseudotyped with protease-activated antibodies.

In certain embodiments, the protease-activated antibody is incorporated into the viral glycoprotein envelope. Protease-activated antibodies can be incorporated into the glycoprotein envelope of a recombinant viral vector of the invention (e.g., an HSV vector) to increase the therapeutic index and reduce off-target infection. In the case of an HSV vector, in some embodiments, the glycoprotein may be gC or gD. In some embodiments, the recombinant oncolytic viruses described herein comprise at least one polynucleotide encoding a protease-activated antibody. In certain embodiments, a protease-activated antibody is activated by a protease selected from a cysteine cathepsin, an aspartic cathepsin, a kallikrein (hK), a serine protease, a caspase, a matrix metalloproteinase (MMP), and a disintegrin and metalloproteinase (ADAM). In some embodiments, a protease is selected from cathepsin K, cathepsin B, cathepsin L, cathepsin E, cathepsin D, hK1, PSA (hK3), hK10, hK15, uPA, uPAR, MMP-1, MMP-2, MMP-3, MMP-7, MMP-8, MMP-9, MMP-10, MMP-11, MMP-12, MMP-13, MMP-14, MMP-15, MMP-16, MMP-17, MMP-18, MMP-19, MMP-20, MMP-21, MMP-23A, MMP-23B, MMP-24, MMP-25, MMP-26, MMP-27, MMP-28, or a protease listed in Table 6.

In some embodiments, the protease-activated antibody binds a protein expressed more highly by cancer cells or in cancer microenvironments than by non-cancer cells or in non-cancer microenvironments. In certain aspects, a protease-activated antibody binds NKG2D, c-met, HGFR, CD8, heparan sulfate, VSPG4 (also known as NG2), EGFR, EGFRvIII, CD133, CXCR4, carcinoembryonic antigen (CEA), CLC-3, annexin II, human transferrin receptor, or EpCAM. In certain instances, multiple protease activated antibodies may be incorporated into a single viral vector particle to ensure that diverse tumor histotypes are targeted. For example, at least 1, 2, 3, 4, 6, 7, 8, 9, 10, or more protease activated antibodies may be incorporated into the viral glycoprotein envelope. In some embodiments, the recombinant oncolytic virus comprises at least 1, 2, 3, 4, 5, 6, 7, 8, 9, 10, or more polynucleotides that encodes for at least 1, 2, 3, 4, 5, 6, 7, 8, 9, 10, or more protease activated antibodies. In some embodiments, an oncolytic virus comprises a first protease-activated antibody that binds a first protein expressed more highly by cancer cells or in cancer microenvironments than by non-cancer cells or in non-cancer microenvironments, and a second protease-activated antibody that binds a second protein expressed more highly by cancer cells or in cancer microenvironments than by non-cancer cells or in non-cancer microenvironments. In further embodiments, an oncolytic virus comprises a plurality of protease-activated antibodies binding a plurality of protein expressed more highly by cancer cells or in cancer microenvironments than by non-cancer cells or in non-cancer microenvironments. An oncolytic virus comprises, for example, a protease-activated antibody that is a human antibody, a humanized antibody or a chimeric antibody. In some embodiments, an oncolytic virus comprises an antibody that is a full-length immunoglobulin, an scFv, a Fab, a Fab', an F(ab')2, an Fv, a diabody, a triabody, a minibody, a single-domain antibody, or a multispecific antibody.

In some embodiments, a recombinant oncolytic virus comprises one or more of: one or more micro-RNA (miR) target sequences inserted into a locus of one or more viral genes required for viral replication; one or more polynucleotides encoding one or more proteins or oligonucleotides, wherein the proteins or oligonucleotides reduce the expression or inhibit the function of a miR, a gene, or a TIMP; at least one protease-activated antibody; and/or a polynucleotide encoding at least one protease activated antibody. In some embodiments, a recombinant oncolytic virus comprises: a plurality of copies of one or more miRNA target sequences inserted into a locus of a viral gene required for viral replication in non-cancerous cells; and/or a first polynucleotide encoding a protein or an oligonucleotide targeted to reduce expression of an oncogenic miRNA or an oncogenic gene; and/or a second polynucleotide encoding a protein or an oligonucleotide targeted to reduce expression of a microenvironment remodeling miRNA or a TIMP. In some embodiments, a recombinant oncolytic virus comprises: a plurality of copies of one or more miRNA target sequences inserted into a locus of a viral gene required for viral replication in non-cancerous cells; and/or a polynucleotide encoding a protein or an oligonucleotide targeted to reduce expression of an oncogenic miRNA or an oncogenic gene; and/or at least one protease-activated antibody. In further embodiments, a recombinant oncolytic virus comprises a plurality of copies of one or more miRNA target sequences inserted into a locus of a viral gene required for viral replication in non-cancerous cells; and/or a polynucleotide encoding a protein or an oligonucleotide targeted to reduce expression of a microenvironment remodeling miRNA or a TIMP; and/or at least one protease-activated antibody. In one embodiment, a recombinant oncolytic virus comprises a plurality of copies of one or more miRNA target sequences inserted into a locus of a viral gene required for viral replication in non-cancerous cells; and/or a first polynucleotide encoding a protein or an oligonucleotide targeted to reduce expression of an oncogenic miRNA or an oncogenic gene; and/or a second polynucleotide encoding a protein or an oligonucleotide targeted to reduce expression of a microenvironment remodeling miRNA or a TIMP; and/or at least one protease-activated antibody. In some specific embodiments, an oncolytic virus described in this paragraph is a herpes simplex virus and the viral gene required for viral replication in non-cancerous cells is UL1, UL5, UL6, UL7, UL8, UL9, UL11, UL12, UL14, UL15, UL17, UL18, UL19, UL20, UL22, UL25, UL26, UL26.5, UL27, UL28, UL29, UL30, UL31, UL32, UL33, UL34, UL35, UL36, UL37, UL38, UL39, UL40, UL42, UL48, UL49, UL52, UL53, UL54, ICP0, ICP4, ICP22, ICP27, ICP47, gamma-34.5, US3, US4, US5, US6, US7, US8, US9, US10, US11, and US12.

In certain aspects, the invention relates to a recombinant oncolytic virus comprising a first polynucleotide encoding a protein or an oligonucleotide targeted to reduce expression of an oncogenic miRNA or an oncogenic gene; and a second polynucleotide encoding a protein or an oligonucleotide targeted to reduce expression of a microenvironment remodeling miRNA or a TIMP. In other embodiments, a recombinant oncolytic virus comprises a polynucleotide encoding a protein or an oligonucleotide targeted to reduce expression of an oncogenic miRNA or an oncogenic gene; and at least one protease-activated antibody. In some embodiments, a recombinant oncolytic virus comprises a polynucleotide encoding a protein or an oligonucleotide targeted to reduce expression of a microenvironment remodeling miRNA or a TIMP; and at least one protease-activated antibody. In one embodiment, a recombinant oncolytic virus comprises a first polynucleotide encoding a protein or an oligonucleotide targeted to reduce expression of an oncogenic miRNA or an oncogenic gene; and/or a second polynucleotide encoding a protein or an oligonucleotide targeted to reduce expression of a microenvironment remodeling miRNA or a TIMP; and/or at least one protease-activated antibody.

In some embodiments, the oncolytic virus is an HSV virus comprising a first miR-TS cassette inserted into the 3' UTR of ICP4 comprising 4 target sequences for each of miR-124-3p, miR-1-3p, and miR-143-3p; a second miR-TS cassette inserted into the 3' UTR of ICP27 comprising 4 target sequences for each of miR-219a-5p, miR-122-5p, and miR128-3p; and a third miR-TS cassette inserted into the 3' UTR of UL8 comprising 4 target sequences for each of miR-137-3p, miR-208b-3p, and miR-126-3p. In some embodiments, the oncolytic virus further comprises a polynucleotide sequence encoding IL-12. In some embodiments, the oncolytic virus further comprises a polynucleotide sequence encoding IL-12 and MMP9. In some embodiments, the oncolytic virus further comprises a polynucleotide sequence encoding CXCL10. In some embodiments, the oncolytic virus further comprises a polynucleotide sequence encoding IL-12 and CXCL10. In some embodiments, the oncolytic virus further comprises a polynucleotide sequence encoding CXCL10 and MMP9. In some embodiments, the oncolytic virus further comprises a polynucleotide sequence encoding IL-12, CXCL10, and XCL1. In some embodiments, the oncolytic virus further comprises a polynucleotide sequence encoding IL-12, CXCL10, and CCL4. In some embodiments, the oncolytic virus further comprises a polynucleotide sequence encoding IL-12, CXCL10, and FLT3L. In some embodiments, the oncolytic virus further comprises a polynucleotide sequence encoding IL-12 and 41BBL. In some embodiments, the oncolytic virus further comprises a polynucleotide sequence encoding IL-12 and CD40L. In some embodiments, the oncolytic virus further comprises a polynucleotide sequence encoding 41BBL and CD40L. In some embodiments, the oncolytic virus further comprises a polynucleotide sequence encoding an anti-CTLA4 antibody or antigen binding fragment thereof. In some embodiments, the oncolytic virus further comprises a polynucleotide sequence encoding an anti-PD1 or anti-PDL1 antibody or antigen binding fragment thereof. In some embodiments, the oncolytic virus comprises a nucleic acid sequence that is at least 95%, 96%, 97%, 98%, or 99% identical to one of SEQ ID NOs: 843, 844, 847, or 848. In some embodiments, the oncolytic virus comprises or consists of the nucleic acid sequence of one of SEQ ID NOs: 843, 844, 847, or 848.

In some embodiments, the oncolytic virus is an HSV virus comprising a first miR-TS cassette inserted into the 3' UTR of ICP4 comprising 4 target sequences for each of miR-124-3p, miR-1-3p, and miR-143-3p; a second miR-TS cassette inserted into the 3' UTR of ICP27 comprising 4 target sequences for each of miR-219a-5p, miR-122-5p, and miR128-3p; a third miR-TS cassette inserted into the 3' UTR of UL8 comprising 4 target sequences for each of miR-137-3p, miR-208b-3p, and miR-126-3p. In some embodiments, the oncolytic virus further comprises a polynucleotide sequence encoding IL-12. In some embodiments, the oncolytic virus further comprises a polynucleotide sequence encoding IL-12. In some embodiments, the oncolytic virus further comprises a polynucleotide sequence encoding IL-12 and MMP9. In some embodiments, the oncolytic virus further comprises a polynucleotide sequence encoding CXCL10. In some embodiments, the oncolytic virus further comprises a polynucleotide sequence encoding IL-12 and CXCL10. In some embodiments, the oncolytic virus further comprises a polynucleotide sequence encoding CXCL10 and MMP9. In some embodiments, the oncolytic virus further comprises a polynucleotide sequence encoding IL-12, CXCL10, and XCL1. In some embodiments, the oncolytic virus further comprises a polynucleotide sequence encoding IL-12, CXCL10, and CCL4. In some embodiments, the oncolytic virus further comprises a polynucleotide sequence encoding IL-12, CXCL10, and FLT3L. In some embodiments, the oncolytic virus further comprises a polynucleotide sequence encoding IL-12 and 41BBL. In some embodiments, the oncolytic virus further comprises a polynucleotide sequence encoding IL-12 and CD40L. In some embodiments, the oncolytic virus further comprises a polynucleotide sequence encoding 41BBL and CD40L. In some embodiments, the oncolytic virus further comprises a polynucleotide sequence encoding an anti-CTLA4 antibody or antigen binding fragment thereof. In some embodiments, the oncolytic virus further comprises a polynucleotide sequence encoding an anti-PD1 or anti-PDL1 antibody or antigen binding fragment thereof. In some embodiments, the oncolytic virus comprises a nucleic acid sequence that is at least 95%, 96%, 97%, 98%, or 99% identical to SEQ ID NO: 845 or 846. In some embodiments, the oncolytic virus comprises or consists of the nucleic acid sequence of one of SEQ ID NOs: 845 or 846.

In some embodiments, the oncolytic virus is an HSV virus comprising a first miR-TS cassette inserted into the 3' UTR of ICP4 comprising 4 target sequences for each of miR-124-3p, miR-1-3p, and miR-143-3p; a second miR-TS cassette inserted into the 3' UTR of ICP27 comprising 4 target sequences for each of miR-219a-5p, miR-122-5p, and miR128-3p; a third miR-TS cassette inserted into the 3' UTR of UL8 comprising 4 target sequences for each of miR-137-3p, miR-208b-3p, and miR-126-3p; and a fourth miR-TS cassette inserted into the 3' UTR of ICP34.5 comprising 4 target sequences for each of miR-128-3p, miR-204-5p, and miR-219a-5p. In some embodiments, the oncolytic virus further comprises a polynucleotide sequence encoding IL-12. In some embodiments, the oncolytic virus further comprises a polynucleotide sequence encoding IL-12. In some embodiments, the oncolytic virus further comprises a polynucleotide sequence encoding IL-12 and MMP9. In some embodiments, the oncolytic virus further comprises a polynucleotide sequence encoding CXCL10. In some embodiments, the oncolytic virus further comprises a polynucleotide sequence encoding IL-12 and CXCL10. In some embodiments, the oncolytic virus further comprises a polynucleotide sequence encoding CXCL10 and MMP9. In some embodiments, the oncolytic virus further comprises a polynucleotide sequence encoding IL-12, CXCL10, and XCL1. In some embodiments, the oncolytic virus further comprises a polynucleotide sequence encoding IL-12, CXCL10, and CCL4. In some embodiments, the oncolytic virus further comprises a polynucleotide sequence encoding IL-12, CXCL10, and FLT3L. In some embodiments, the oncolytic virus further comprises a polynucleotide sequence encoding IL-12 and 41BBL. In some embodiments, the oncolytic virus further comprises a polynucleotide sequence encoding IL-12 and CD40L. In some embodiments, the oncolytic virus further comprises a polynucleotide sequence encoding 41BBL and CD40L. In some embodiments, the oncolytic virus further comprises a polynucleotide sequence encoding an anti-CTLA4 antibody or antigen binding fragment thereof. In some embodiments, the oncolytic virus further comprises a polynucleotide sequence encoding an anti-PD1 or anti-PDL1 antibody or antigen binding fragment thereof. In some embodiments, the oncolytic virus comprises a nucleic acid sequence that is at least 95%, 96%, 97%, 98%, or 99% identical to SEQ ID NO: 850. In some embodiments, the oncolytic virus comprises or consists of the nucleic acid sequence of SEQ ID NO: 850.

In some embodiments, the oncolytic virus is an HSV virus comprising a first miR-TS cassette inserted into the 3' UTR of ICP4 comprising 4 target sequences for each of miR-124-3p, miR-1-3p, and miR-143-3p; a second miR-TS cassette inserted into the 3' UTR of ICP27 comprising 4 target sequences for each of miR-219a-5p, miR-122-5p, and miR128-3p; a third miR-TS cassette inserted into the 3' UTR of UL8 comprising 4 target sequences for each of miR-137-3p, miR-217-5p, and miR-126-3p; and a fourth miR-TS cassette inserted into the 3' UTR of ICP34.5 comprising 4 target sequences for each of miR-128-3p, miR-204-5p, and miR-219a-5p. In some embodiments, the oncolytic virus further comprises a polynucleotide sequence encoding IL-12. In some embodiments, the oncolytic virus further comprises a polynucleotide sequence encoding IL-12. In some embodiments, the oncolytic virus further comprises a polynucleotide sequence encoding IL-12 and MMP9. In some embodiments, the oncolytic virus further comprises a polynucleotide sequence encoding CXCL10. In some embodiments, the oncolytic virus further comprises a polynucleotide sequence encoding IL-12 and CXCL10. In some embodiments, the oncolytic virus further comprises a polynucleotide sequence encoding CXCL10 and MMP9. In some embodiments, the oncolytic virus further comprises a polynucleotide sequence encoding IL-12, CXCL10, and XCL1. In some embodiments, the oncolytic virus further comprises a polynucleotide sequence encoding IL-12, CXCL10, and CCL4. In some embodiments, the oncolytic virus further comprises a polynucleotide sequence encoding IL-12, CXCL10, and FLT3L. In some embodiments, the oncolytic virus further comprises a polynucleotide sequence encoding IL-12 and 41BBL. In some embodiments, the oncolytic virus further comprises a polynucleotide sequence encoding IL-12 and CD40L. In some embodiments, the oncolytic virus further comprises a polynucleotide sequence encoding 41BBL and CD40L. In some embodiments, the oncolytic virus further comprises a polynucleotide sequence encoding an anti-CTLA4 antibody or antigen binding fragment thereof. In some embodiments, the oncolytic virus further comprises a polynucleotide sequence encoding an anti-PD1 or anti-PDL1 antibody or antigen binding fragment thereof. In some embodiments, the oncolytic virus comprises a nucleic acid sequence that is at least 95%, 96%, 97%, 98%, or 99% identical to SEQ ID NO: 849. In some embodiments, the oncolytic virus comprises or consists of the nucleic acid sequence of SEQ ID NO: 849.

In some embodiments, the oncolytic virus is an HSV virus comprising a first miR-TS cassette inserted into the 3' UTR of ICP4 comprising 4 target sequences for each of miR-124-3p, miR-1-3p, and miR-143-3p; a second miR-TS cassette inserted into the 3' UTR of ICP27 comprising 4 target sequences for each of miR-219a-5p, miR-122-5p, and miR128-3p; a third miR-TS cassette inserted into the 3' UTR of UL8 comprising 4 target sequences for each of miR-137-3p, miR-217-5p, and miR-126-3p; and a fourth miR-TS cassette inserted into the 3' UTR of ICP34.5 comprising 4 target sequences for each of miR-128-3p, miR-204-5p, and miR-219a-5p. In some embodiments, the oncolytic virus further comprises a polynucleotide sequence encoding IL-12. In some embodiments, the oncolytic virus further comprises a polynucleotide sequence encoding IL-12. In some embodiments, the oncolytic virus further comprises a polynucleotide sequence encoding IL-12 and MMP9. In some embodiments, the oncolytic virus further comprises a polynucleotide sequence encoding CXCL10. In some embodiments, the oncolytic virus further comprises a polynucleotide sequence encoding IL-12 and CXCL10. In some embodiments, the oncolytic virus further comprises a polynucleotide sequence encoding CXCL10 and MMP9. In some embodiments, the oncolytic virus further comprises a polynucleotide sequence encoding IL-12, CXCL10, and XCL1. In some embodiments, the oncolytic virus further comprises a polynucleotide sequence encoding IL-12, CXCL10, and CCL4. In some embodiments, the oncolytic virus further comprises a polynucleotide sequence encoding IL-12, CXCL10, and FLT3L. In some embodiments, the oncolytic virus further comprises a polynucleotide sequence encoding IL-12 and 41BBL. In some embodiments, the oncolytic virus further comprises a polynucleotide sequence encoding IL-12 and CD40L. In some embodiments, the oncolytic virus further comprises a polynucleotide sequence encoding 41BBL and CD40L. In some embodiments, the oncolytic virus further comprises a polynucleotide sequence encoding an anti-CTLA4 antibody or antigen binding fragment thereof. In some embodiments, the oncolytic virus further comprises a polynucleotide sequence encoding an anti-PD1 or anti-PDL1 antibody or antigen binding fragment thereof. In some embodiments, the oncolytic virus comprises a nucleic acid sequence that is at least 95%, 96%, 97%, 98%, or 99% identical to SEQ ID NO: 851. In some embodiments, the oncolytic virus comprises or consists of the nucleic acid sequence of SEQ ID NO: 851.

The invention also encompasses a nucleic acid molecule encoding an oncolytic virus described herein.

Compositions and Methods of Use

Certain aspects of the invention relate to stocks and compositions comprising the oncolytic viruses described herein. In some aspects, the invention relates to a viral stock comprising an oncolytic virus described herein. In some embodiments, a viral stock is a homogeneous stock. The preparation and analysis of viral stocks is well known in the art. For example, a viral stock can be manufactured in roller bottles containing cells transduced with the viral vector. The viral stock can then be purified on a continuous nycodenze gradient, and aliquotted and stored until needed. Viral stocks vary considerably in titer, depending largely on viral genotype and the protocol and cell lines used to prepare them.

In particular embodiments, the titer of a viral stock (e.g., an HSV-based vector viral stock) contemplated herein is at least about $10^5$ plaque-forming units (pfu), such as at least about $10^6$ pfu or even more preferably at least about $10^7$ pfu. In certain embodiments, the titer can be at least about $10^8$ pfu, or at least about $10^9$ pfu, and high titer stocks of at least about $10^{10}$ pfu or at least about $10^{11}$ pfu are most preferred.

The invention further contemplates a composition comprising an oncolytic virus or a nucleic acid molecule described herein and a pharmaceutically acceptable carrier. The phrase "pharmaceutically-acceptable" refers to molecular entities and compositions that do not produce an allergic or similar untoward reaction when administered to a subject (e.g., a human). The term "composition" as used herein refers to a formulation of one or more oncolytic virus or a nucleic acid molecules described herein that is capable of being administered or delivered to a subject and/or a cell. Typically, formulations include all physiologically acceptable compositions including derivatives and/or prodrugs, solvates, stereoisomers, racemates, or tautomers thereof with any physiologically acceptable carriers, diluents, and/or excipients. A "therapeutic composition" or "pharmaceutical composition" (used interchangeably herein) is a composition of one or more agents capable of being administered or delivered to a patient and/or subject and/or cell for the treatment of a particular disease or disorder.

The compositions disclosed herein may be formulated in a neutral or salt form. "Pharmaceutically acceptable salt" includes both acid and base addition salts. Pharmaceutically-acceptable salts include the acid addition salts (formed with the free amino groups of the protein) and which are formed with inorganic acids such as, for example, hydrochloric acid, hydrobromic acid, sulfuric acid, nitric acid, phosphoric acid and the like, and organic acids such as, but not limited to, acetic acid, 2,2-dichloroacetic acid, adipic acid, alginic acid, ascorbic acid, aspartic acid, benzenesulfonic acid, benzoic acid, 4-acetamidobenzoic acid, camphoric acid, camphor-10-sulfonic acid, capric acid, caproic acid, caprylic acid, carbonic acid, cinnamic acid, citric acid, cyclamic acid, dodecylsulfuric acid, ethane-1,2-disulfonic acid, ethanesulfonic acid, 2-hydroxyethanesulfonic acid, formic acid, fumaric acid, galactaric acid, gentisic acid, glucoheptonic acid, gluconic acid, glucuronic acid, glutamic acid, glutaric acid, 2-oxo-glutaric acid, glycerophosphoric acid, glycolic acid, hippuric acid, isobutyric acid, lactic acid, lactobionic acid, lauric acid, maleic acid, malic acid, malonic acid, mandelic acid, methanesulfonic acid, mucic acid, naphthalene-1,5-disulfonic acid, naphthalene-2-sulfonic acid, 1-hydroxy-2-naphthoic acid, nicotinic acid, oleic acid, orotic acid, oxalic acid, palmitic acid, pamoic acid, propionic acid, pyroglutamic acid, pyruvic acid, salicylic acid, 4-aminosalicylic acid, sebacic acid, stearic acid, succinic acid, tartaric acid, thiocyanic acid, ptoluenesulfonic acid, trifluoroacetic acid, undecylenic acid, and the like. Salts formed with the free carboxyl groups can also be derived from inorganic bases such as, for example, sodium, potassium, lithium, ammonium, calcium, magnesium, iron, zinc, copper, manganese, aluminum salts and the like. Salts derived from organic bases include, but are not limited to, salts of primary, secondary, and tertiary amines, substituted amines including naturally occurring substituted amines, cyclic amines and basic ion exchange resins, such as ammonia, isopropylamine, trimethylamine, diethylamine, triethylamine, tripropylamine, diethanolamine, ethanolamine, deanol, 2-dimethylaminoethanol, 2-diethylaminoethanol, dicyclohexylamine, lysine, arginine, histidine, caffeine, procaine, hydrabamine, choline, betaine, benethamine, benzathine, ethylenediamine, glucosamine, methylglucamine, theobromine, triethanolamine, tromethamine, purines, piperazine, piperidine, N-ethylpiperidine, polyamine resins and the like. Particularly preferred organic bases are isopropylamine, diethylamine, ethanolamine, trimethylamine, dicyclohexylamine, choline and caffeine. Upon formulation, solutions will be administered in a manner compatible with the dosage formulation and in such amount as is therapeutically effective. The formulations are easily administered in a variety of dosage forms such as injectable solutions, drug-release capsules, and the like.

As used herein, "carrier" includes any and all solvents, dispersion media, vehicles, coatings, diluents, antibacterial and antifungal agents, isotonic and absorption delaying agents, buffers, carrier solutions, suspensions, colloids, and the like. The use of such media and agents for pharmaceutical active substances is well known in the art. Except insofar as any conventional media or agent is incompatible with the active ingredient, its use in the therapeutic compositions is contemplated. Supplementary active ingredients can also be incorporated into the compositions.

As used herein "pharmaceutically acceptable carrier" includes without limitation any adjuvant, carrier, excipient, glidant, sweetening agent, diluent, preservative, dye/colorant, flavor enhancer, surfactant, wetting agent, dispersing agent, suspending agent, stabilizer, isotonic agent, solvent, surfactant, dispersion media, coatings, antibacterial and antifungal agents, isotonic and absorption delaying agents, and the like that are physiologically compatible, including pharmaceutically acceptable cell culture media and/or emulsifier which has been approved by the United States Food and Drug Administration as being acceptable for use in humans and/or domestic animals. Exemplary pharmaceutically acceptable carriers include, but are not limited to, to sugars, such as lactose, glucose and sucrose; starches, such as corn starch and potato starch; cellulose, and its derivatives, such as sodium carboxymethyl cellulose, ethyl cellulose and cellulose acetate; tragacanth; malt; gelatin; talc; cocoa butter, waxes, animal and vegetable fats, paraffins, silicones, bentonites, silicic acid, zinc oxide; oils, such as peanut oil, cottonseed oil, safflower oil, sesame oil, olive oil, corn oil and soybean oil; glycols, such as propylene glycol; polyols, such as glycerin, sorbitol, mannitol and polyethylene glycol; esters, such as ethyl oleate and ethyl laurate; agar; buffering agents, such as magnesium hydroxide and aluminum hydroxide; alginic acid; pyrogen-free water; isotonic saline; Ringer's solution; ethyl alcohol; phosphate buffer solutions; and any other compatible substances employed in pharmaceutical formulations. Except insofar as any conventional media and/or agent is incompatible with the agents of the present disclosure, its use in therapeutic compositions is contemplated. Supplementary active ingredients also can be incorporated into the compositions.

Wetting agents, emulsifiers and lubricants, such as sodium lauryl sulfate and magnesium stearate, as well as coloring agents, release agents, coating agents, sweetening, flavoring and perfuming agents, preservatives and antioxidants can also be present in the compositions.

Examples of pharmaceutically-acceptable antioxidants include: (1) water soluble antioxidants, such as ascorbic acid, cysteine hydrochloride, sodium bisulfate, sodium metabisulfite, sodium sulfite and the like; (2) oil-soluble antioxidants, such as ascorbyl palmitate, butylated hydroxyanisole (BHA), butylated hydroxytoluene (BHT), lecithin, propyl gallate, alpha-tocopherol, and the like; and (3) metal chelating agents, such as citric acid, ethylenediamine tetraacetic acid (EDTA), sorbitol, tartaric acid, phosphoric acid, and the like.

In one embodiment, a composition comprising a carrier is suitable for parenteral administration, e.g., intravascular (intravenous or intraarterial), intraperitoneal or intramuscular administration. Pharmaceutically acceptable carriers include sterile aqueous solutions or dispersions and sterile powders for the extemporaneous preparation of sterile injectable solutions or dispersion. The use of such media and agents for pharmaceutically active substances is well known in the art. Except insofar as any conventional media or agent is incompatible with a viral vector or nucleic acid molecule, use thereof in the pharmaceutical compositions of the invention is contemplated.

The compositions of the invention may comprise one or more polypeptides, polynucleotides, vectors comprising same, infected cells, etc., as described herein, formulated in pharmaceutically-acceptable or physiologically-acceptable solutions for administration to a cell or an animal, either alone, or in combination with one or more other modalities of therapy. It will also be understood that, if desired, the compositions of the invention may be administered in combination with other agents as well, such as, e.g., cytokines, growth factors, hormones, small molecules or various pharmaceutically-active agents. There is virtually no limit to other components that may also be included in the compositions, provided that the additional agents do not adversely affect the ability of the composition to deliver the intended therapy.

In the pharmaceutical compositions of the invention, formulation of pharmaceutically-acceptable excipients and carrier solutions is well-known to those of skill in the art, as is the development of suitable dosing and treatment regimens for using the particular compositions described herein in a variety of treatment regimens. Upon formulation, solutions are administered in a manner compatible with the dosage formulation and in such amount as is therapeutically effective to result in an improvement or remediation of the symptoms. The formulations are easily administered in a variety of dosage forms such as ingestible solutions, drug release capsules and the like. Some variation in dosage can occur depending on the condition of the subject being treated. The person responsible for administration can, in any event, determine the appropriate dose for the individual subject. Moreover, for human administration, preparations meet sterility, general safety and purity standards as required by FDA Center for Biologics Evaluation and Research standards. The route of administration will vary, naturally, with the location and nature of the disease being treated, and may include, for example intradermal, transdermal, subdermal, parenteral, nasal, intravenous, intramuscular, intranasal, subcutaneous, percutaneous, intratracheal, intraperitoneal, intratumoral, perfusion, lavage, direct injection, and oral administration.

In certain circumstances it will be desirable to deliver the compositions, recombinant viral vectors, and nucleic acid molecules disclosed herein parenterally, intravenously, intramuscularly, or even intraperitoneally as described, for example, in U.S. Pat. Nos. 5,543,158; 5,641,515 and 5,399,363 (each specifically incorporated herein by reference in its entirety). Solutions of the active compounds as free base or pharmacologically acceptable salts may be prepared in water suitably mixed with a surfactant, such as hydroxypropylcellulose. Dispersions may also be prepared in glycerol, liquid polyethylene glycols, and mixtures thereof and in oils. Under ordinary conditions of storage and use, these preparations contain a preservative to prevent the growth of microorganisms.

The pharmaceutical forms suitable for injectable use include sterile aqueous solutions or dispersions and sterile powders for the extemporaneous preparation of sterile injectable solutions or dispersions (U.S. Pat. No. 5,466,468, specifically incorporated herein by reference in its entirety). In all cases the form should be sterile and should be fluid to the extent that easy syringability exists. It should be stable under the conditions of manufacture and storage and should be preserved against the contaminating action of microorganisms, such as bacteria and fungi. The carrier can be a solvent or dispersion medium containing, for example, water, ethanol, polyol (e.g., glycerol, propylene glycol, and liquid polyethylene glycol, and the like), suitable mixtures thereof, and/or vegetable oils. Proper fluidity may be maintained, for example, by the use of a coating, such as lecithin, by the maintenance of the required particle size in the case of dispersion and by the use of surfactants. The prevention of the action of microorganisms can be facilitated by various antibacterial and antifungal agents, for example, parabenes, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin. The preparation of an aqueous composition that contains a protein as an active ingredient is well understood in the art. Typically, such compositions are prepared as injectables, either as liquid solutions or suspensions; solid forms suitable for solution in, or suspension in, liquid prior to injection can also be prepared. The preparation can also be emulsified.

For parenteral administration in an aqueous solution, for example, the solution should be suitably buffered if necessary and the liquid diluent first rendered isotonic with sufficient saline or glucose. These particular aqueous solutions are especially suitable for intravenous, intramuscular, subcutaneous and intraperitoneal administration. In this connection, a sterile aqueous medium that can be employed will be known to those of skill in the art in light of the present disclosure. For example, one dosage may be dissolved in 1 ml of isotonic NaCl solution and either added to 1000 ml of hypodermoclysis fluid or injected at the proposed site of infusion (see, e.g., Remington: The Science and Practice of Pharmacy, 20th Edition. Baltimore, MD: Lippincott Williams & Wilkins, 2000). Some variation in dosage will necessarily occur depending on the condition of the subject being treated. The person responsible for administration will, in any event, determine the appropriate dose for the individual subject. Moreover, for human administration, preparations should meet sterility, pyrogenicity, and the general safety and purity standards as required by FDA Office of Biologics standards.

Sterile injectable solutions can be prepared by incorporating the active compounds in the required amount in the appropriate solvent with the various other ingredients enumerated above, as required, followed by filtered sterilization. Generally, dispersions are prepared by incorporating the various sterilized active ingredients into a sterile vehicle which contains the basic dispersion medium and the required other ingredients from those enumerated above. In the case of sterile powders for the preparation of sterile injectable solutions, the preferred methods of preparation are vacuum-drying and freeze-drying techniques which yield a powder of the active ingredient plus any additional desired ingredient from a previously sterile-filtered solution thereof.

In certain embodiments, the compositions may be delivered by intranasal sprays, inhalation, and/or other aerosol delivery vehicles. Methods for delivering polynucleotides and peptide compositions directly to the lungs via nasal aerosol sprays has been described e.g., in U.S. Pat. Nos. 5,756,353 and 5,804,212 (each specifically incorporated herein by reference in its entirety). Likewise, the delivery of drugs using intranasal microparticle resins (Takenaga et al., 1998) and lysophosphatidyl-glycerol compounds (U.S. Pat. No. 5,725,871, specifically incorporated herein by reference in its entirety) are also well-known in the pharmaceutical arts. Likewise, transmucosal drug delivery in the form of a polytetrafluoroetheylene support matrix is described in U.S. Pat. No. 5,780,045 (specifically incorporated herein by reference in its entirety).

In certain embodiments, the delivery may occur by use of liposomes, nanocapsules, microparticles, microspheres, lipid particles, vesicles, optionally mixing with CPP polypeptides, and the like, for the introduction of the compositions of the present invention into suitable host cells. In particular, the compositions of the present invention may be formulated for delivery either encapsulated in a lipid particle, a liposome, a vesicle, a nanosphere, a nanoparticle or the like. The formulation and use of such delivery vehicles can be carried out using known and conventional techniques. The formulations and compositions of the invention may comprise one or more polypeptides, polynucleotides, and small molecules, as described herein, formulated in pharmaceutically-acceptable or physiologically-acceptable solutions (e.g., culture medium) for administration to a cell or an animal, either alone, or in combination with one or more other modalities of therapy. It will also be understood that, if desired, the compositions of the invention may be administered in combination with other agents as well, such as, e.g., cells, other proteins or polypeptides or various pharmaceutically-active agents.

In a particular embodiment, a formulation or composition according to the present invention comprises a cell contacted with a combination of any number of polynucleotides or viral vectors, as contemplated herein.

In certain aspects, the present invention provides formulations or compositions suitable for the delivery of viral vector systems.

Exemplary formulations for ex vivo delivery may also include the use of various transfection agents known in the art, such as calcium phosphate, electroporation, heat shock and various liposome formulations (i.e., lipid-mediated transfection). Liposomes are lipid bilayers entrapping a fraction of aqueous fluid. DNA spontaneously associates to the external surface of cationic liposomes (by virtue of its charge) and these liposomes will interact with the cell membrane.

Particular embodiments of the invention may comprise other formulations, such as those that are well known in the pharmaceutical art, and are described, for example, in Remington: The Science and Practice of Pharmacy, 20th Edition. Baltimore, MD: Lippincott Williams & Wilkins, 2000.

In certain aspects, the present invention provides pharmaceutically acceptable compositions which comprise a therapeutically effective amount of one or more viral vectors or polynucleotides, as described herein, formulated together with one or more pharmaceutically acceptable carriers (additives) and/or diluents (e.g., pharmaceutically acceptable cell culture medium). As used herein, a "therapeutically effective amount" refers to the amount of a composition or recombinant virus described herein required to achieve a desired physiologic and/or biological outcome. A "therapeutically effective amount" of a virus, a viral stock, or a composition may vary according to factors such as the disease state, age, sex, and weight of the individual, and the ability of the stem and progenitor cells to elicit a desired response in the individual. A therapeutically effective amount is also one in which any toxic or detrimental effects of the virus or transduced therapeutic cells are outweighed by the therapeutically beneficial effects. The term "therapeutically effective amount" includes an amount that is effective to "treat" a subject (e.g., a patient). The therapeutically effective amount may be quantified by the total number of plaque forming units (pfu) (e.g. at least $1e^1$ to at least $1e^{20}$, particularly about $1e^4$ to about $1e^{15}$, more particularly about $1e^6$ to about $1e^{12}$ pfu), or number of viral genomes (e.g. at least $1e^1$ to at least $1e^{20}$, particularly about $1e^4$ to about $1e^{15}$, more particularly about $1e^6$ to about $1e^{12}$ viral genomes). One of skill in the art will understand that the therapeutically effective amount will vary based on the type of virus being administered, nature of the formulation, route of administration, nature and/or severity of the disease to be treated, and/or general health and well-being of the subject.

Some aspects of the invention encompass a method of killing a cancerous cell, comprising exposing the cancerous cell to an oncolytic virus described herein or compositions thereof under conditions sufficient for the oncolytic virus to infect and replicate within said cancerous cell, and wherein replication of the oncolytic virus within the cancerous cell results in cell death. In certain embodiments, the cancerous cell has a reduced expression of a miR compared to a non-cancerous cell. In some embodiments, a cancerous cell killed by this method is in vivo. In certain embodiments, a cancerous cell killed by this method is within a tumor.

The invention relates to a method of treating cancer in a subject in need thereof, comprising administering a prophylactically effective amount or a therapeutically effective amount of an oncolytic virus, a viral stock, or a composition as described herein to the subject. A "subject," as used herein, includes any animal that exhibits a symptom of a disease, disorder, or condition that can be treated with the recombinant viral vectors, compositions, and methods disclosed herein. Suitable subjects (e.g., patients) include laboratory animals (such as mouse, rat, rabbit, or guinea pig), farm animals (such as horse or cow), and domestic animals or pets (such as cat or dog). Non-human primates and, preferably, human patients, are included.

"Administration" refers herein to introducing an oncolytic virus, a viral stock, or a composition thereof into a subject or contacting an oncolytic virus, a viral stock, or a composition thereof with a cell and/or tissue. Administration can occur by injection, irrigation, inhalation, consumption, electro-osmosis, hemodialysis, iontophoresis, and other methods known in the art. The route of administration will vary, naturally, with the location and nature of the disease being treated, and may include, for example auricular, buccal, conjunctival, cutaneous, dental, endocervical, endosinusial, endotracheal, enteral, epidural, interstitial, intra-articular, intraarterial, intra-abdominal, intraauricular, intrabiliary, intrabronchial, intrabursal, intracavernous, intracerebral, intracisternal, intracorneal, intracronal, intracoronary, intracranial, intradermal, intradiscal, intraductal, intraduodenal, intraduodenal, intradural, intraepicardial, intraepidermal, intraesophageal, intragastric, intragingival, intrahepatic, intraileal, intralesional, intralingual, intraluminal, intralymphatic, intramammary, intramedulleray, intrameningeal, instramuscular, intranasal, intranodal, intraocular, intraomentum, intraovarian, intraperitoneal, intrapericardial, intrapleural, intraprostatic, intrapulmonary, intraruminal, intrasinal, intraspinal, intrasynovial, intratendinous, intratesticular, intratracheal, intrathecal, intrathoracic, intratubular, intratumoral, intratympanic, intrauterine, intraperitoneal, intravascular, intraventricular, intravesical, intravestibular, intravenous, intravitreal, larangeal, nasal, nasogastric, oral, ophthalmic, oropharyngeal, parenteral, percutaneous, periarticular, peridural, perineural, periodontal, respiratory, retrotubular, rectal, spinal, subarachnoid, subconjunctival, subcutaneous, subdermal, subgingival, sublingual, submucosal, subretinal, topical, transdermal, transendocardial, transmucosal, transplacental, trantracheal, transtympanic, ureteral, urethral, and/or vaginal perfusion, lavage, direct injection, and oral administration.

The term "treating" and "treatment" as used herein refers to administering to a subject a therapeutically effective amount of a recombinant virus or composition thereof as described herein so that the subject has an improvement in a disease or condition, or a symptom of the disease or condition. The improvement is any improvement or remediation of the disease or condition, or symptom of the disease or condition. The improvement is an observable or measurable improvement, or may be an improvement in the general feeling of well-being of the subject. Thus, one of skill in the art realizes that a treatment may improve the disease condition, but may not be a complete cure for the disease. A "prophylactically effective amount" refers to an amount of a virus, a viral stock, or a composition effective to achieve the desired prophylactic result. As used herein, "prophylaxis" can mean complete prevention of the symptoms of a disease, a delay in onset of the symptoms of a disease, or a lessening in the severity of subsequently developed disease symptoms. Typically, but not necessarily, since a prophylactic dose is used in subjects prior to or at an earlier stage of disease, the prophylactically effective amount is less than the therapeutically effective amount.

"Cancer" herein refers to or describes the physiological condition in mammals that is typically characterized by unregulated cell growth. Examples of cancer include but are not limited to carcinoma, lymphoma, blastoma, sarcoma (including liposarcoma, osteogenic sarcoma, angiosarcoma, endotheliosarcoma, leiomyosarcoma, chordoma, lymphangiosarcoma, lymphangioendotheliosarcoma, rhabdomyosarcoma, fibrosarcoma, myxosarcoma, chondrosarcoma), neuroendocrine tumors, mesothelioma, synovioma, schwannoma, meningioma, adenocarcinoma, melanoma, and leukemia or lymphoid malignancies. More particular examples of such cancers include squamous cell cancer (e.g. epithelial squamous cell cancer), lung cancer including small-cell lung cancer, non-small cell lung cancer, adenocarcinoma of the lung and squamous carcinoma of the lung, small cell lung carcinoma, cancer of the peritoneum, hepatocellular cancer, gastric or stomach cancer including gastrointestinal cancer, pancreatic cancer, glioblastoma, cervical cancer, ovarian cancer, liver cancer, bladder cancer, hepatoma, breast cancer, colon cancer, rectal cancer, colorectal cancer, endometrial or uterine carcinoma, salivary gland carcinoma, kidney or renal cancer, prostate cancer, vulvar cancer, thyroid cancer, hepatic carcinoma, anal carcinoma, penile carcinoma, testicular cancer, esophageal cancer, tumors of the biliary tract, Ewing's tumor, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilms' tumor, testicular tumor, lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, retinoblastoma, leukemia, lymphoma, multiple myeloma, Waldenstrom's macroglobulinemia, myelodysplastic disease, heavy chain disease, neuroendocrine tumors, Schwannoma, and other carcinomas, as well as head and neck cancer.

In certain embodiments, an oncolytic virus (e.g., an HSV), a viral stock, or a composition as described herein are used to treat a cancer selected from lung cancer (e.g., small cell lung cancer or non-small cell lung cancer), breast cancer, ovarian cancer, cervical cancer, prostate cancer, testicular cancer, colorectal cancer, colon cancer, pancreatic cancer, liver cancer (e.g., hepatocellular carcinoma (HCC)), gastric cancer, head and neck cancer, thyroid cancer, malignant glioma, glioblastoma, melanoma, B-cell chronic lymphocytic leukemia, diffuse large B-cell lymphoma (DLBCL), and marginal zone lymphoma (MZL).

In certain aspects, the invention relates to an oncolytic viral vector as shown in any one of the figures or embodiments disclosed herein.

EXAMPLES

The following examples for the purpose of illustrating various embodiments of the invention and are not meant to limit the present invention in any fashion. The present examples, along with the methods described herein, are exemplary, and are not intended as limitations on the scope of the invention. Alterations, modifications, and other changes to the described embodiments which are encompassed within the spirit of the invention as defined by the scope of the claims are specifically contemplated.

Example 1—miR Sequence Analysis of Normal and Malignant Cells

Differential miR expression is a hallmark of many cancers (Lu et al, Nature, 2005). Experiments were performed to determine the miRs that were mostly highly differentially expressed in eight different cancer cells lines. Differential expression was determined by comparisons to non-cancerous control tissues. In total, 108 samples were sequenced. Sample details are provided in Table 11.

TABLE 11

| Cancer Type | # of Cancer Cell Lines | # of Control Tissue Samples |
|---|---|---|
| Bladder | 8 | 4 |
| Colon | 8 | 3 |
| Breast | 12 | 4 |
| Pancreatic | 7 | 3 |
| Lung | 8 | 5 |
| Head and Neck | 6 | 6 |
| Schwannoma | 7 | 4* |
| Glioblastoma | 14 | 4* |
| Additional Controls | | |
| Normal Liver | 3 | |
| Normal Bone Marrow | 3 | |

*Same control samples used for both Schwannoma and glioblastoma analysis

To facilitate the identification of appropriate miRNA target sequences suitable for HSV attenuation in select cell types, miRNA sequence profiling of cancer lines and non-cancer control tissue was performed. Sequencing libraries of dicer-processed RNAs were generated for cancer and non-cancer cells, including bladder, colon, breast, pancreas, lung, head and neck, schwannoma, glioblastoma, brain, liver, and bone marrow. These miRNA sequencing libraries were normalized to total RNA, and sequenced using a HiSeq 2500 ultra-high throughput sequencing system with HiSeq V4 chemistry reagents for sequencing reads up to $3e^8$ reads/run (Illumina). FASTQ files from sequencing runs were analyzed using the miRNAs Analysis tool in Basespace (Illumina). Rankings were made by calculating the mean of normal, the mean of cancer and sorting the ratio of normal/cancer from high to low. Heat maps were generated with natural logarithmic values with zero and negative values converted to zero (scale: black is high, white is low expression). Normalized data across samples were expressed as normalized miRNA read counts in a given sample. Normalization is related to total number of reads in a given sample relative to other samples in the comparison.

Figure 1:
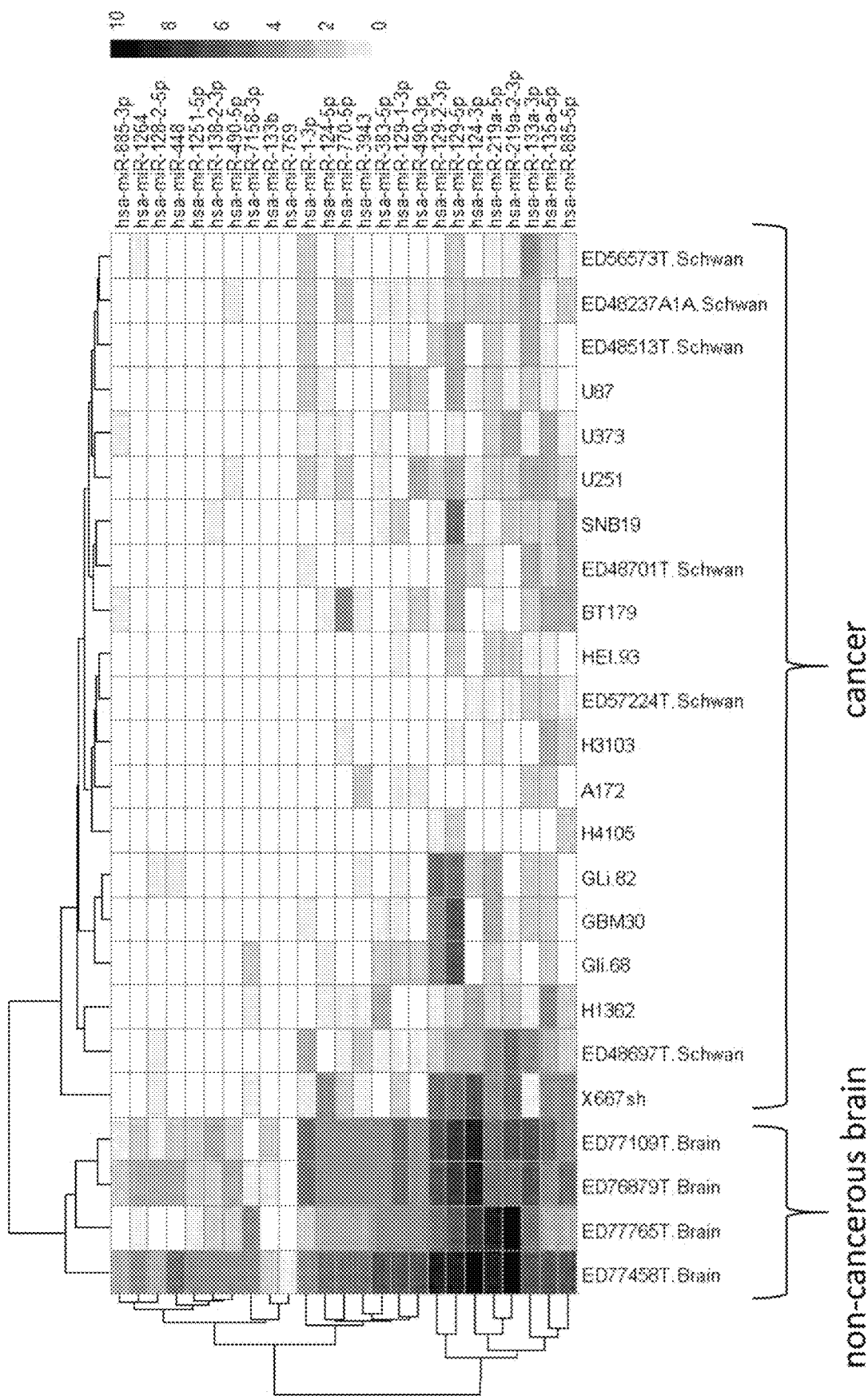
FIG. 1 illustrates a heat map of an miRNA expression profile in cancerous and non-cancerous brain tissue corresponding to 25 selected miRNAs.
Figure 2:
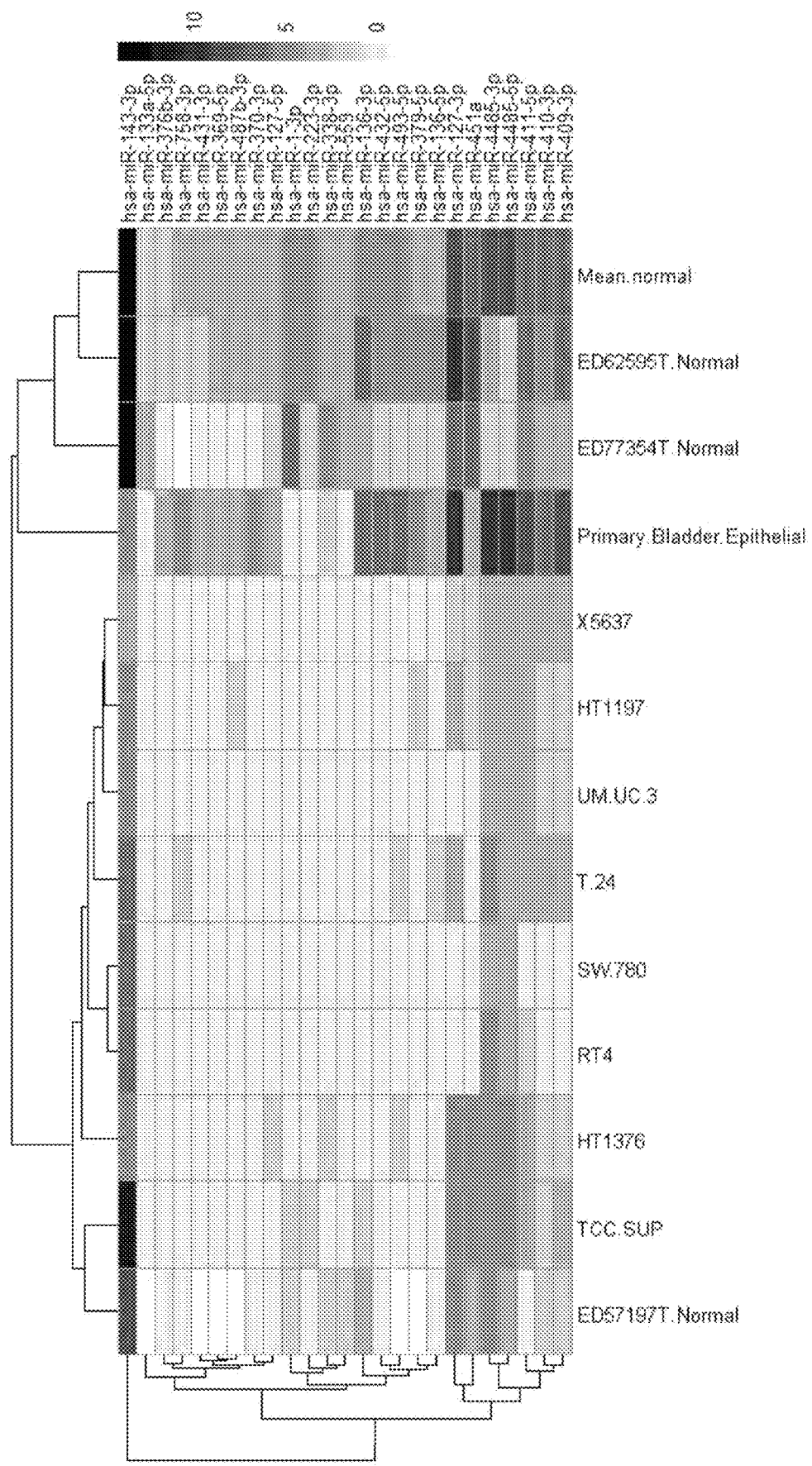
FIG. 2 illustrates a heat map of an miRNA expression profile in cancerous and non-cancerous bladder tissue corresponding to 25 selected miRNAs.
Figure 3:
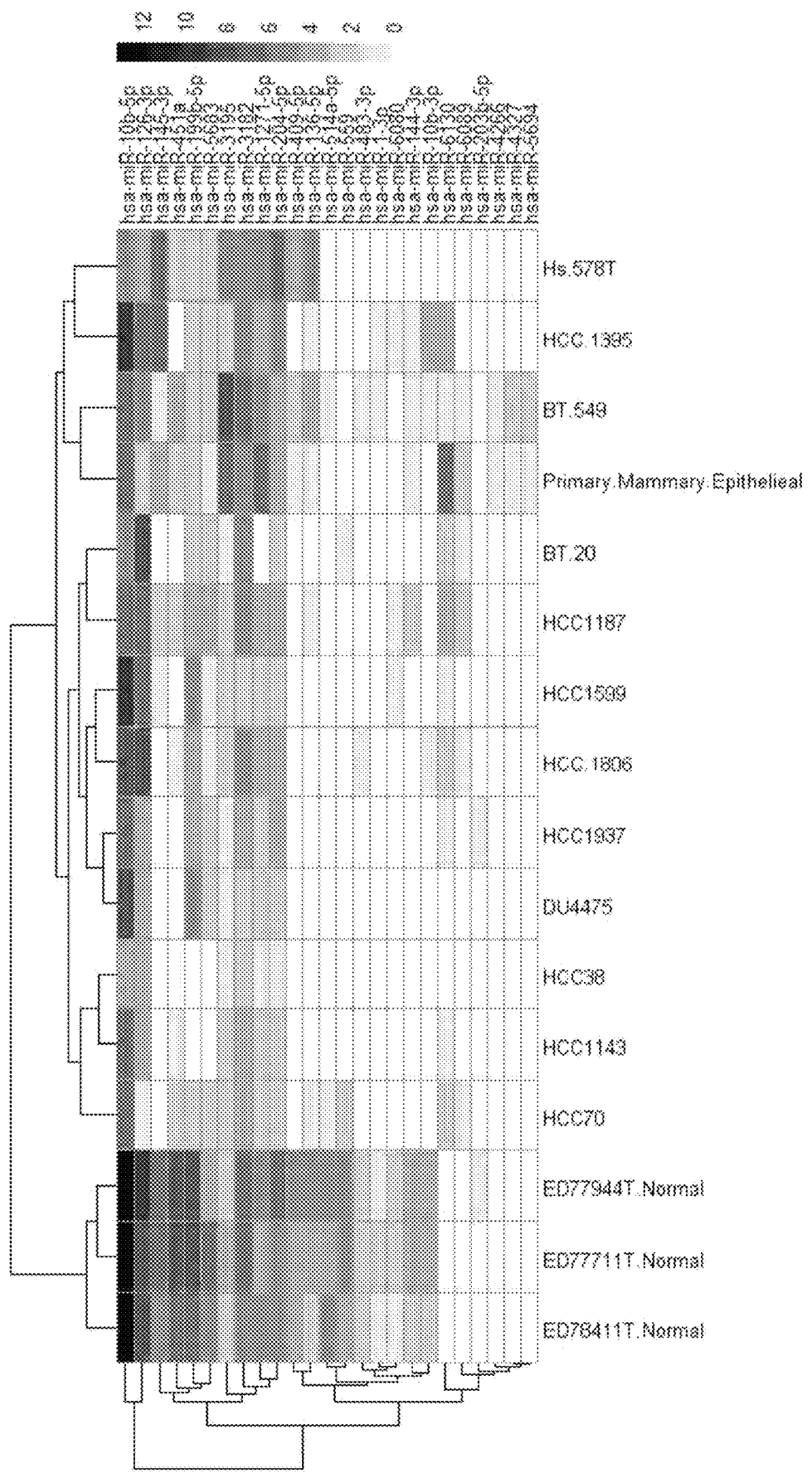
FIG. 3 illustrates a heat map of an miRNA expression profile in cancerous and non-cancerous breast tissue corresponding to 25 selected miRNAs.
Figure 4:
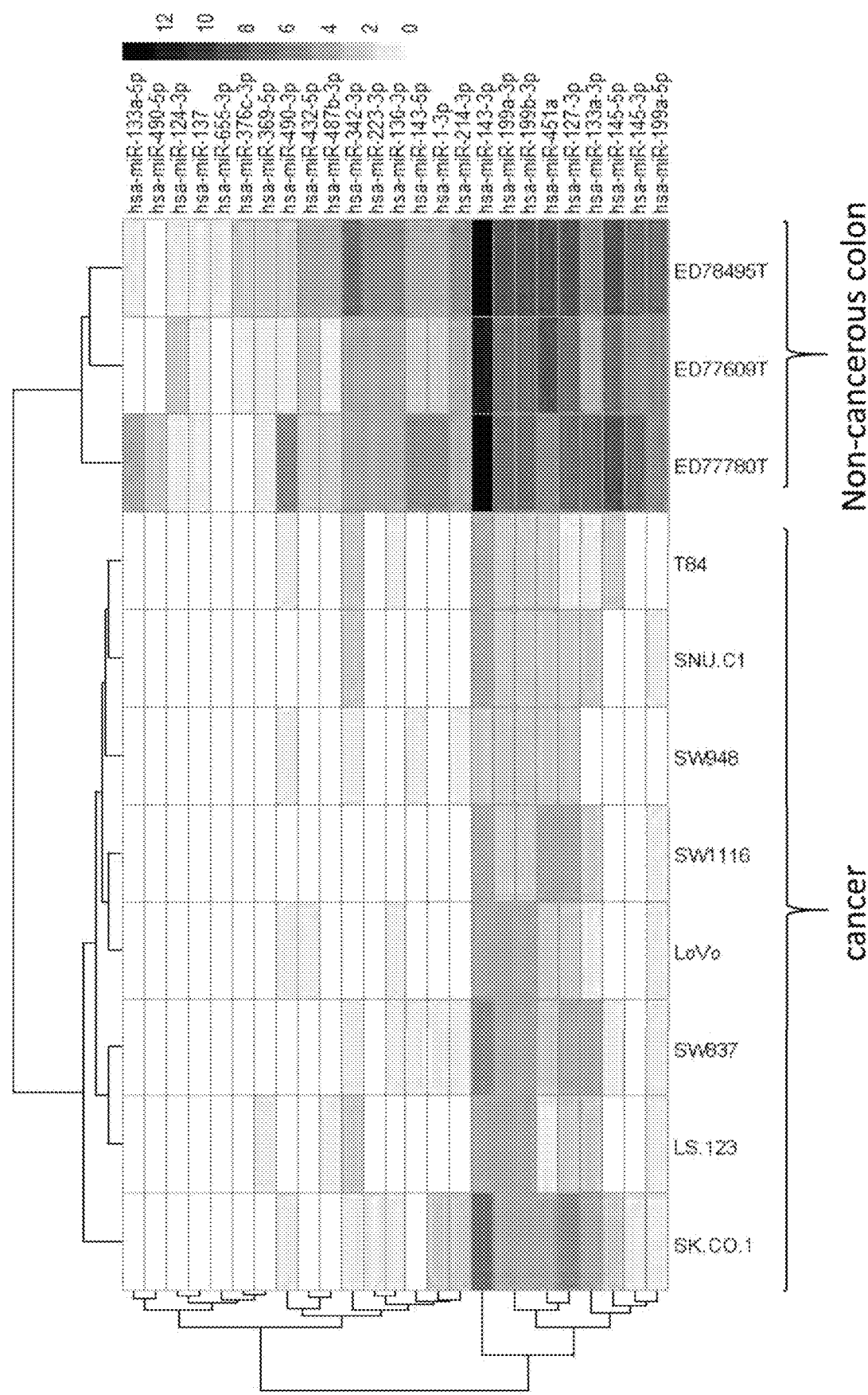
FIG. 4 illustrates a heat map of an miRNA expression profile in cancerous and non-cancerous colon tissue corresponding to 25 selected miRNAs.
Figure 5:
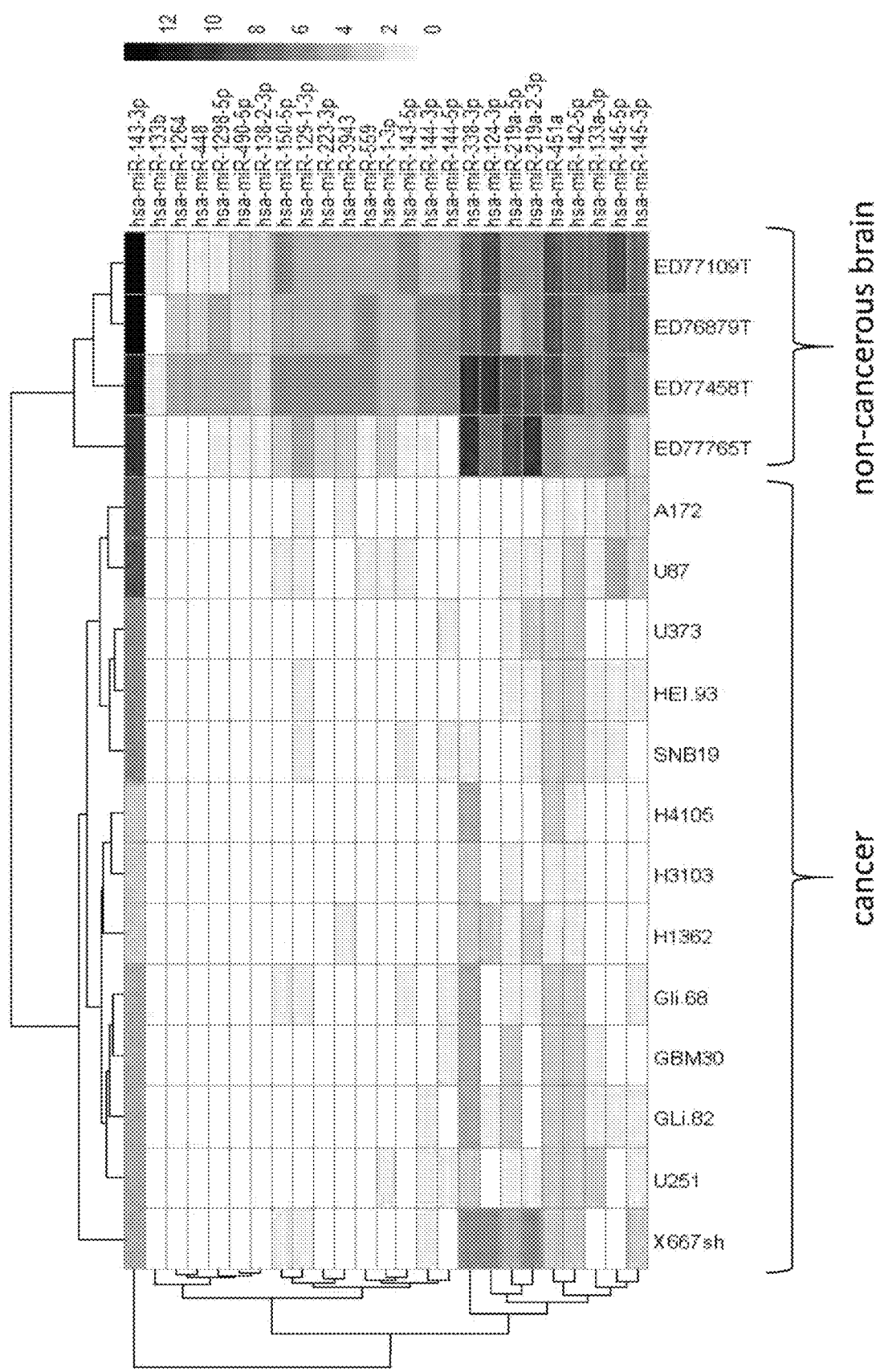
FIG. 5 illustrates a heat map of an miRNA expression profile in glioblastoma and non-cancerous brain tissue corresponding to 25 selected miRNAs.
Figure 6:
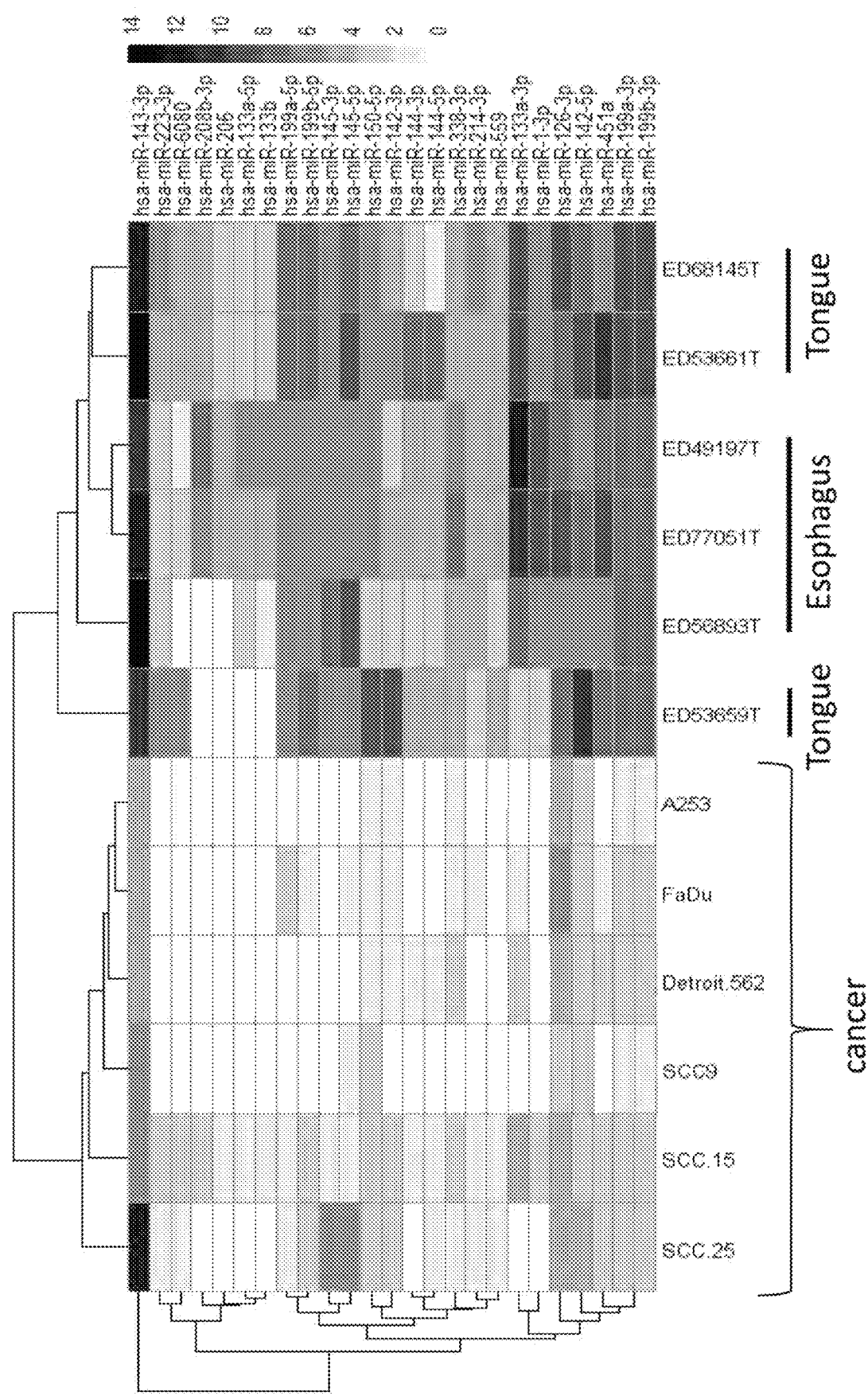
FIG. 6 illustrates a heat map of an miRNA expression profile in cancerous and non-cancerous head and neck tissue corresponding to 25 selected miRNAs.
Figure 7:
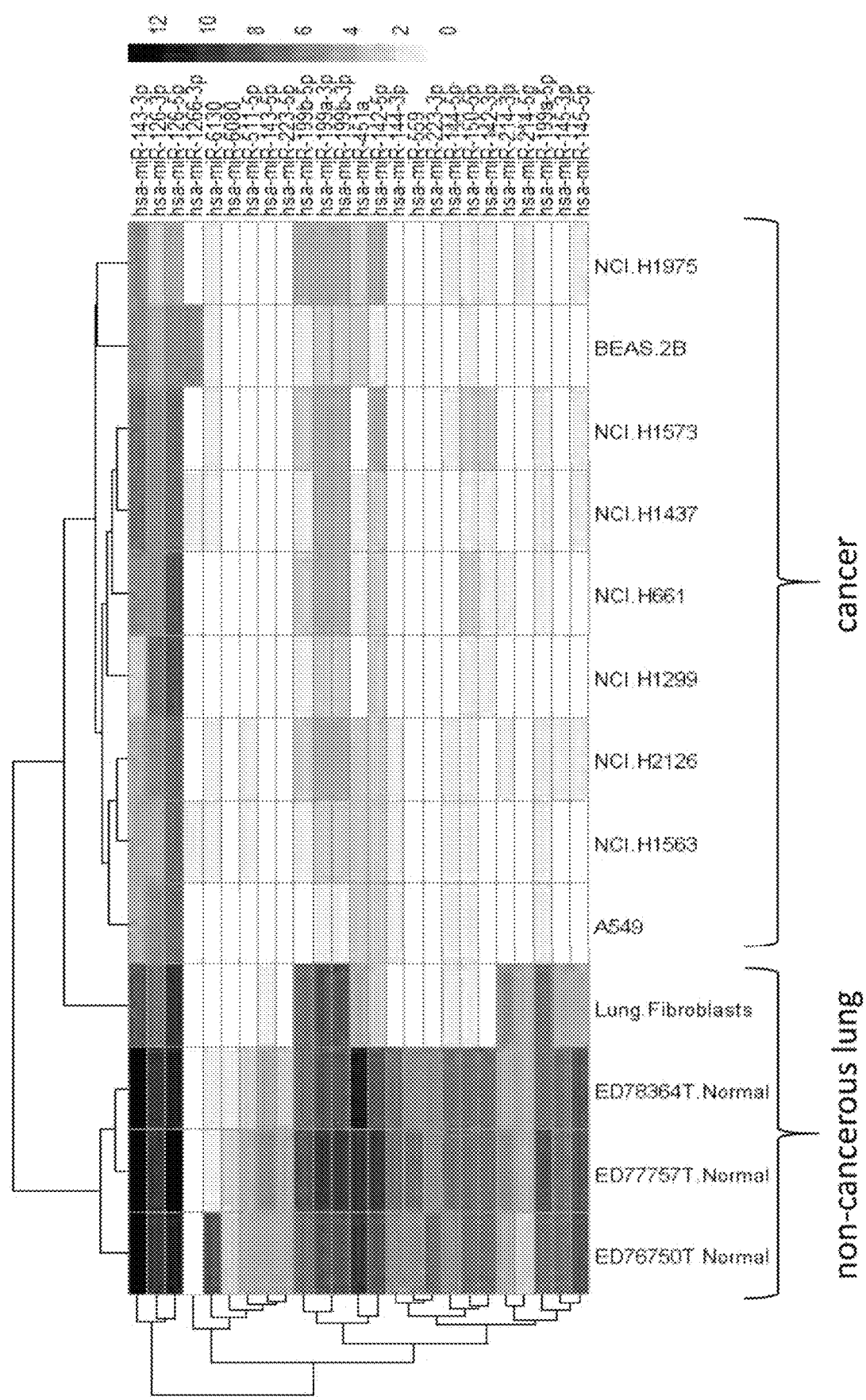
FIG. 7 illustrates a heat map of an miRNA expression profile in cancerous and non-cancerous lung tissue corresponding to 25 selected miRNAs.
Figure 8:
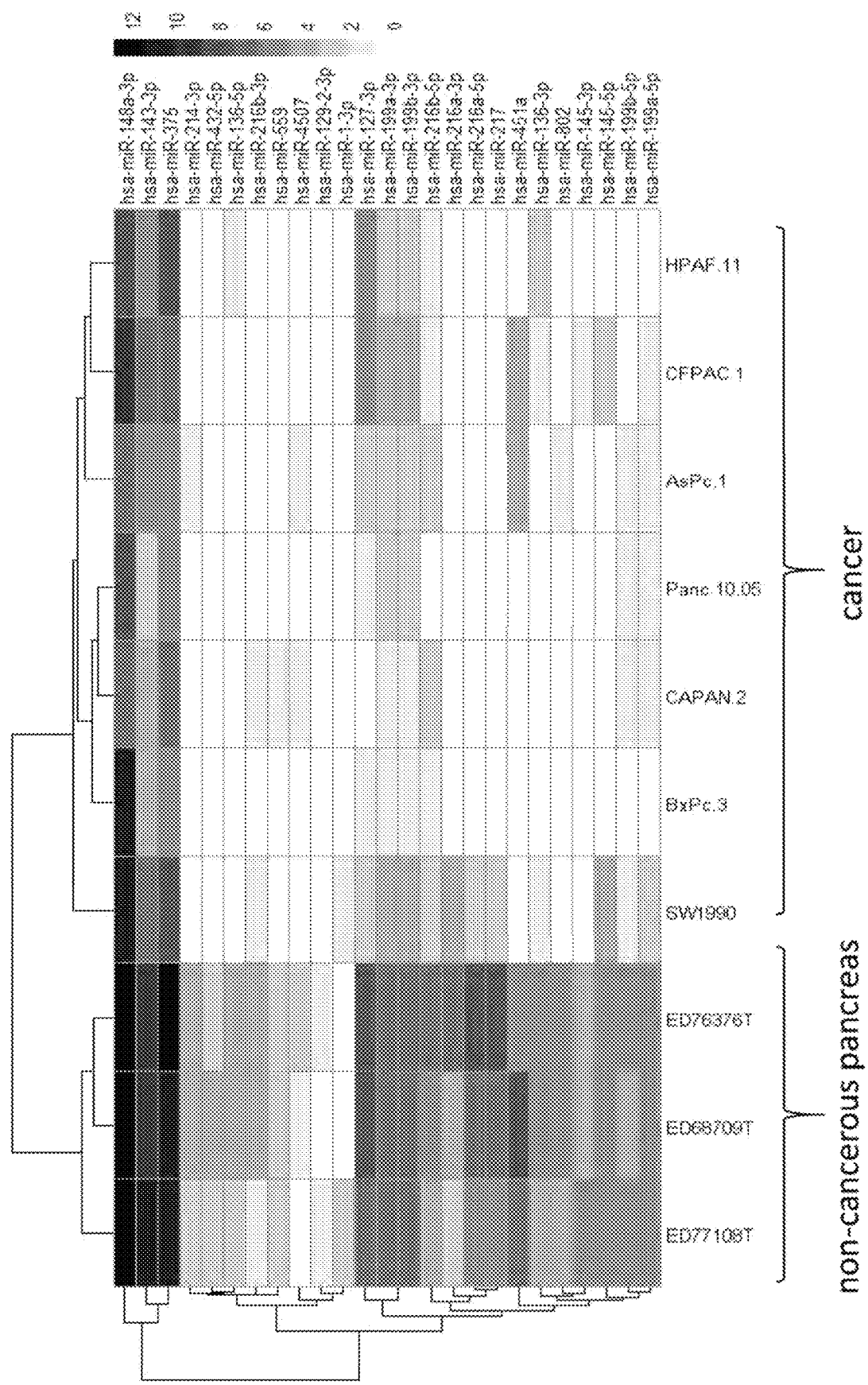
FIG. 8 illustrates a heat map of an miRNA expression profile in cancerous and non-cancerous pancreatic tissue corresponding to 25 selected miRNAs.
Figure 9:
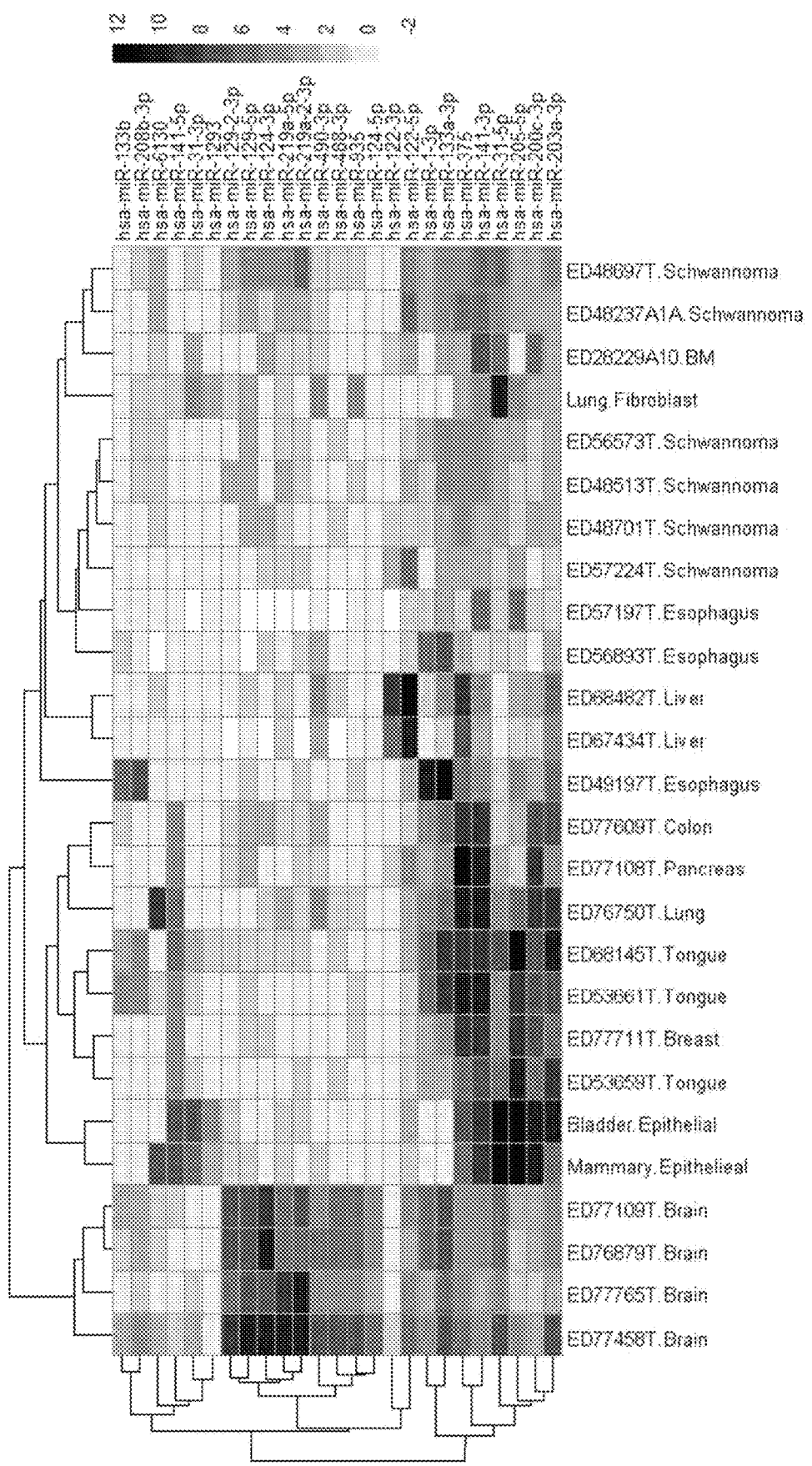
FIG. 9 illustrates a heat map of an miRNA expression profile in schwannoma and non-schwannoma tissue corresponding to 25 selected miRNAs.

FIG. 1 exemplifies the miRNA expression profile heat map in non-cancerous and cancerous brain tissue of twenty-five miRNAs. Additional examples of miRNA expression profile heat maps are shown for non-cancerous and cancerous bladder (FIG. 2), breast (FIG. 3), colon (FIG. 4), brain (FIG. 5), head and neck (FIG. 6), lung (FIG. 7), pancreas (FIG. 8), and schwannoma (FIG. 9) tissue corresponding to twenty-five miRNAs in each example. Table 12 shows a summary of the expression levels of particular miRs between cancerous and non-cancerous tissue. As shown, miR-451a levels are down regulated in all tumor types compared to non-cancerous tissue, representing a potential pan-tumor suppressor miRNA. miR-1-3p is down-regulated in all tumor types tested, present at moderate levels in non-cancerous tissue, and present at high levels in head and neck tissue. miR-559 is down-regulated in all tumor types tested, present generally at low levels in non-cancerous tissue, and present at high levels in non-cancerous lung tissue. miR-145-5p is down-regulated in all tumor types tested and present generally at high levels in the majority of non-cancerous tissue types tested. miR-143-3p is down-regulated in colon, lung, and pancreatic tumors, and is present at high levels in all normal tissue types and some breast tumor lines. miRNA data analysis revealed at least eleven miRNAs that represent novel and unexpected miRNA expression profiles not previously identified in the literature.

of broadly treating a variety of cancer types. Although the mean expression for miR-451a, miR-559, miR-1-3p, miR-145-3p, and miR143-3p was lower in cancer cell lines compared to normal controls, the decreased expression was not fully penetrant across all cancer cell lines. For example, 2/3 of the normal bladder samples tested showed increased expression of miR-145-3p, while expression in the remaining sample was substantially similar to the average observed in the cancer cell lines. Similar results were observed in breast cancer cell lines. Although the average read count for all breast cancer samples was 106, 5/12 samples had a normalized read count of >1000 counts, 2 of which were >40,000 counts.

These data indicate the potential to generate a single miR-attenuated oncolytic virus capable of targeting a broad array of tumor types. For example, a construct comprising target sequences for miR-124, miR-451a, miR-559, miR-1, and miR-145-3p may be used in the treatment of all the tumor types tested (e.g., bladder, colon, breast, pancreatic, lung, head and neck, Schwannoma, and glioblastoma). The variability in expression levels of miRs in different cancer types indicates the potential need to stratify patients by miR expression or through the use of an additional biomarker.

Additional miRNA profiling between cancerous and non-cancerous tissues was performed using a quantitative expression assay from Nanostring. The results of these experiments are shown for brain samples (FIG. 50), and demonstrate the identification of additional miRNAs that exhibit differential expression in cancerous and non-cancerous brain tissue that were not previously identified by the earlier studies outlined above, namely miR-9-5p, miR-128-3p, miR-137, miR-129-2-3p, and miR-487b-3p. Additional results are shown for heart samples (FIG. 51), demonstrating differential expression of miR-208b-3p, miR-1-3p, miR-208a-3p, miR133-3p, miR-4284, and miR-499a-5p between cancerous and non-cancerous heart tissue. Additional results are shown for peripheral nervous system samples (FIG.

TABLE 12

| Tissue | miR-451a | | miR-1-3p | | miR-559 | | miR-145-5p | | miR-143-3p | |
|---|---|---|---|---|---|---|---|---|---|---|
| | Norm | Can | Norm | Can | Norm | Can | Norm | Can | Norm | Can |
| Bladder | 1402.9 | 21.1 | 175 | 0.8 | 14 | 0.4 | 971.5 | 39.8 | 489028.8 | 14904.6 |
| Breast | 2262.1 | 3.9 | 3 | 0.3 | 88.4 | 0.9 | 406.1 | 106.6 | 125943.9 | 91543.1 |
| Colon | 3606.9 | 22 | 149.3 | 1.6 | 40.8 | 2.1 | 1177.3 | 0.5 | 809955.6 | 193.9 |
| Glioma | 4269.7 | 16.7 | 75.2 | 1 | 162.7 | 0.4 | 2399.2 | 7.2 | 514114.8 | 1248.6 |
| Head & Neck | 11919.8 | 10.3 | 2846.6 | 2.6 | 71.2 | 2.2 | 690.9 | 30.4 | 331034.2 | 20706.2 |
| Lung | 31442 | 10.5 | 73.3 | 1.4 | 548.3 | 0.1 | 1547.5 | 1 | 436136.8 | 390.9 |
| Pancreatic | 1035.8 | 13.3 | 4.1 | 0.4 | 13.3 | 0.5 | 81.7 | 0.5 | 25557 | 269.8 |

Many of these identified miRNAs are pan- or multi-tumor specific. For example, expression of miR-451a, miR-559, miR-1-3p, miR-145-3p, and miR143-3p were generally down-regulated across all cancer cell lines tested compared to control tissues. This was particularly notable for miR-451a, which was highly expressed in all normal tissue type and substantially down-regulated in all cancer types, thus representing a pan-specific tumor-suppressive miRNA. The expression of miR-559 was lower in normal tissue types, except for normal lung tissue, and expression of miR-1-3p and mir-145-3p in normal tissue was variable. Despite the variability in the magnitude of differences and absolute expression levels, mean expression of each miR in cancer cells lines was substantially lower compared to levels in the corresponding normal tissues. These miRNAs are candidates for generating pan-tumor HSV virions that are capable 52A-B), demonstrating differential expression of miR-204-5p, miR-1-3p, miR-206, miR-9-5p, miR-199b-5p, miR-145-5p, miR-100-5p, miR-574-3p. Specifically, miR-219a-2-3p, miR-9-5, miR-219a-5p, and miR-204-5p are differentially expressed in the spinal cord.

Example 2—Identification of Viral Genes for miR-T Attenuation siRNA screens were performed to test the attenuation phenotype HSV genes. An siRNA screen is the ideal modality to test RISC attenuation phenotype of immediate early genes, and select early genes. siRNAs targeting the HSV genes ICP27, ICP4, ICP0, UL5, UL8, UL9, ICP8, ULC39/40, ICP22, UL30, UL42, and VP19 were transfected individually and in pools into A253 cells. 24 hours after siRNA transfection, cells were infected with ONCR-003 or ONCR-010 (described below in Table 13), each of which comprise a GFP cassette. Viral spread was measured 48 hours post-infection by quantifying GFP intensity. HSV genes identified as potential hits were validated by Western blots, viral titer measurements, and RT-PCR.

The results of these screen are shown in FIGS. 47A and 47B. Individual siRNAs mediating >75% knockdown of the corresponding HSV gene are indicated by arrows in FIG. 47A and GFP intensity for a select subset of the siRNAs are shown in FIG. 47B. As shown in FIG. 48, siRNA-mediated knockdown of ICP4, UL5, UL8, ICP8, ICP22, and UL30 substantially reduced viral replication of ONCR-003 as indicated by a reduction in GFP intensity. Further, siRNA-mediated knockdown of ICP27, ICP4, UL5, UL8, UL9, ICP8, ICP22, and ICP30 substantially reduced viral replication of ONCR-010 as indicated by a reduction in GFP intensity. Cells infected with ONCR-010 were further analyzed by Western blot for expression of particular viral proteins. As shown in FIG. 49, significant reduction in these HSV genes was also observed at the protein level.

Figure 10A:
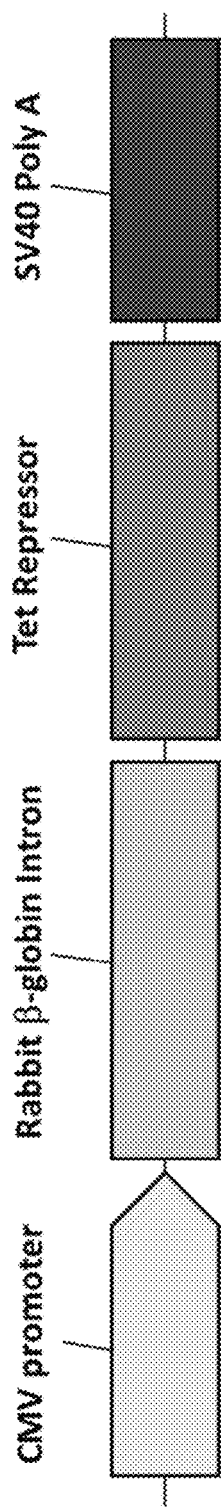
FIG. 10A-FIG. 10C illustrate an miRNA expression and attenuation reporter gene system described in Example 2.
Figure 10B:
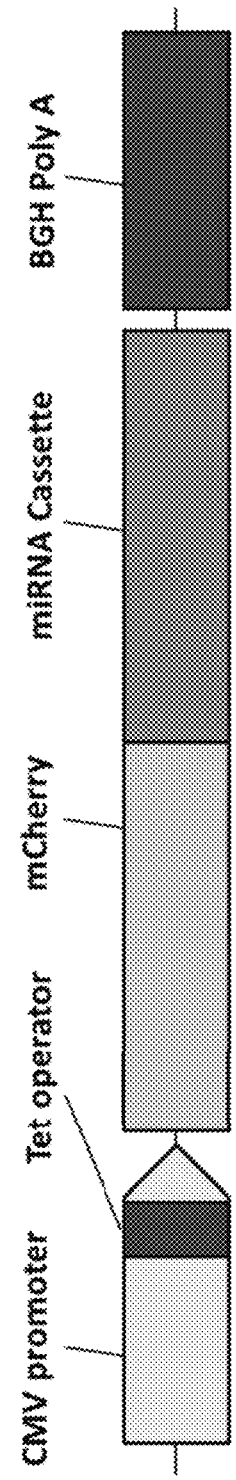
Figure 10C:
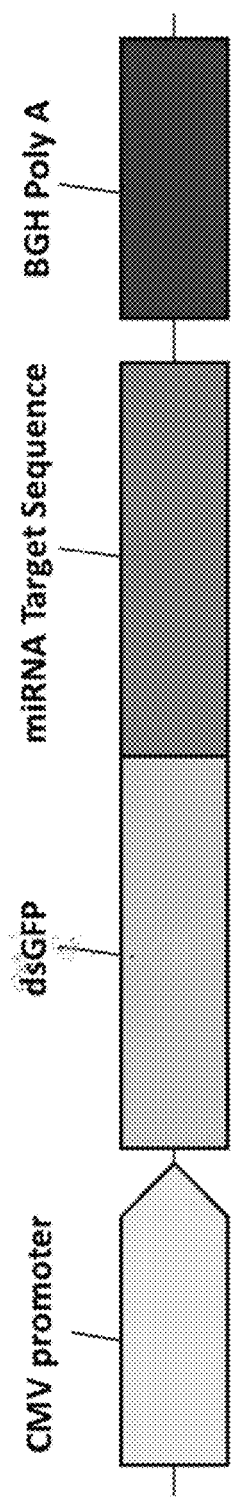

Example 3—Construction and Use of a Reporter System to Rapidly Assay miRNA-Based Gene Attenuation A reporter system was developed to assess miRNA-based gene attenuation using virtually any miRNA target sequence and cognate miRNA. In this system (shown in FIG. 10), the target sequence recognized by miRNAs (i.e. hsa-miR-122) was inserted into the 3' UTR of de-stabilized green fluorescent protein (dsGFP). The cognate miRNA was then expressed via a tetracycline (tet) inducible promoter using mCherry as a control for miRNA expression. All expression vectors were cloned into a tet repressible vector pcDNA5 Frt/To that also expresses mCherry (pTF002). All miRNAs for expression generated by gene synthesis from human genomic DNA and were cloned into pTF002. To generate attenuation reporter vectors, dsGFP was cloned into cDNA3.1+, generating vector pTF004. Attenuation vectors contain four tandem repeats of the reverse complement of the miRNA sequence of interest separated by 8-16 nucleotides. Plasmids were constructed by insertion of synthetically generated oligonucleotides into the 3 'UTR of the dsGFP gene of pTF004 using standard molecular biology techniques. On day one, HEK293TetR cells were transfected with the miRNA attenuation and reporter expression plasmids (0.15 μg each, for a total of 0.3 μg of CMV promotor-containing plasmid) using Lipofectamine 2000 per manufacturers protocol (Invitrogen). On day two, cells were treated with Tetracycline at 5 ng/ml and allowed to incubate for up to 72 hours. After incubation, GFP and mCherry fluorescence signals were detected daily using a SpectraMax® i3x Minimax multi-mode microplate reader (Molecular Devices) and analyzed using Softmax Pro or Metamorph imaging software (Molecular Devices). Phase images were acquired with an exposure of 5-6 ms. Fluorescence images were acquired with a GFP (541 nm channel) exposure of 10 ms, and an mCherry (713 nm channel) of 200-1500 ms.

Figure 11:
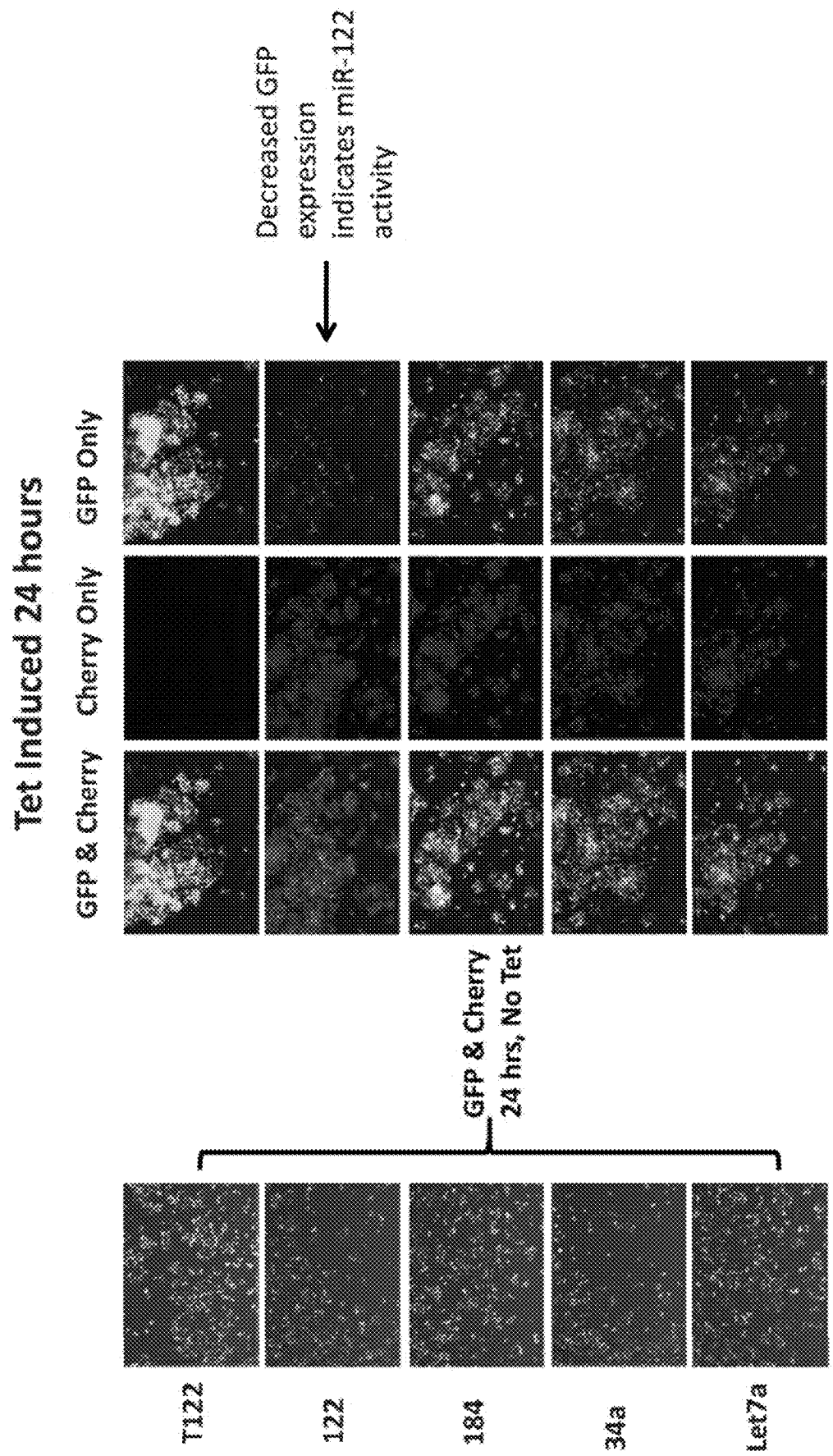
FIG. 11 illustrates miR-122 expression and attenuation using the reporter system shown in FIG. 10 and described in Example 2.
Figure 12:
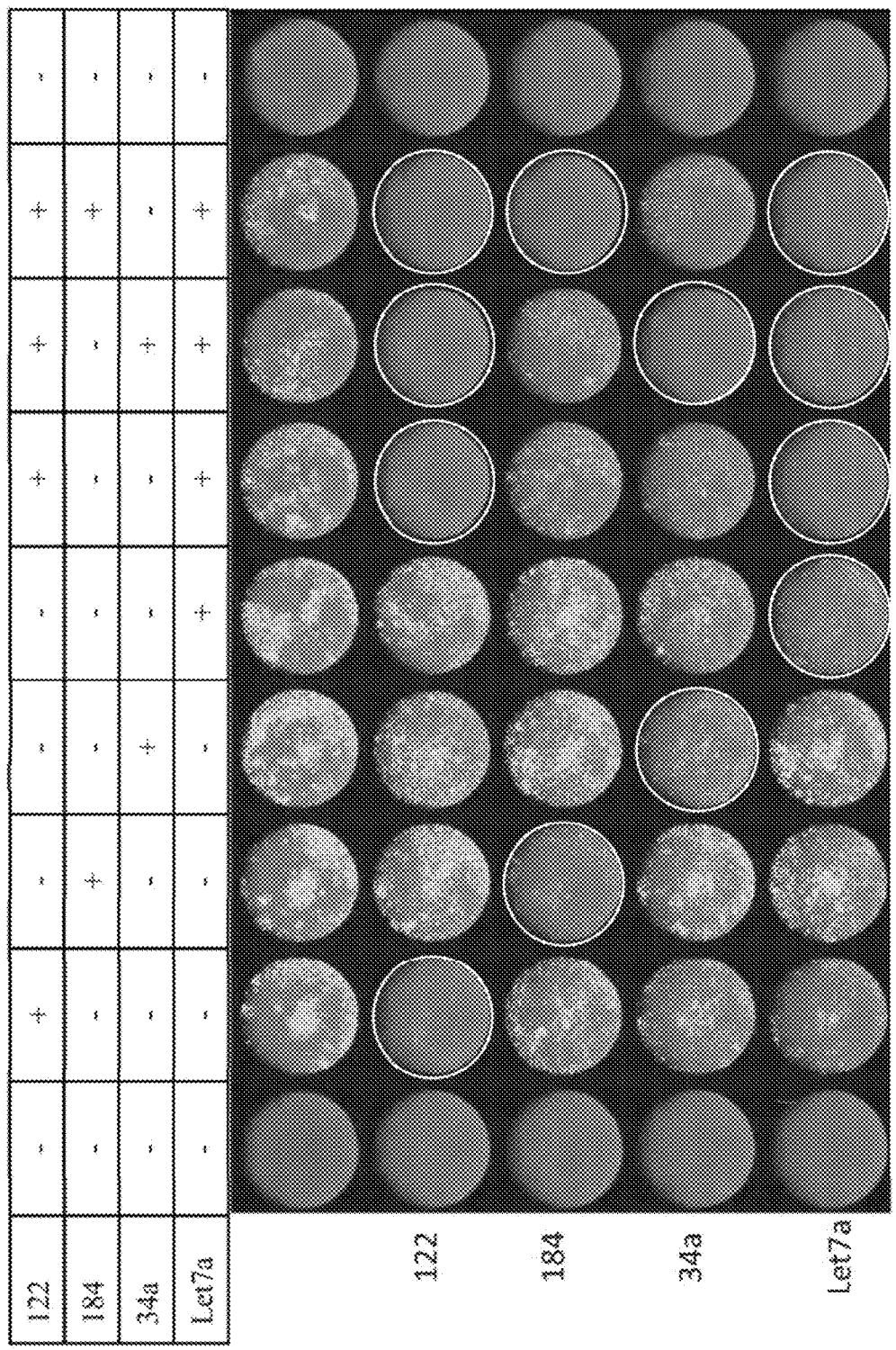
FIG. 12 illustrates miR-122, miR-184, miR-34a, and Let7a-mediated GFP attenuation using the reporter system shown in FIG. 10 and described in Example 2. Circled wells indicate reduced GFP expression levels.
Figure 13:
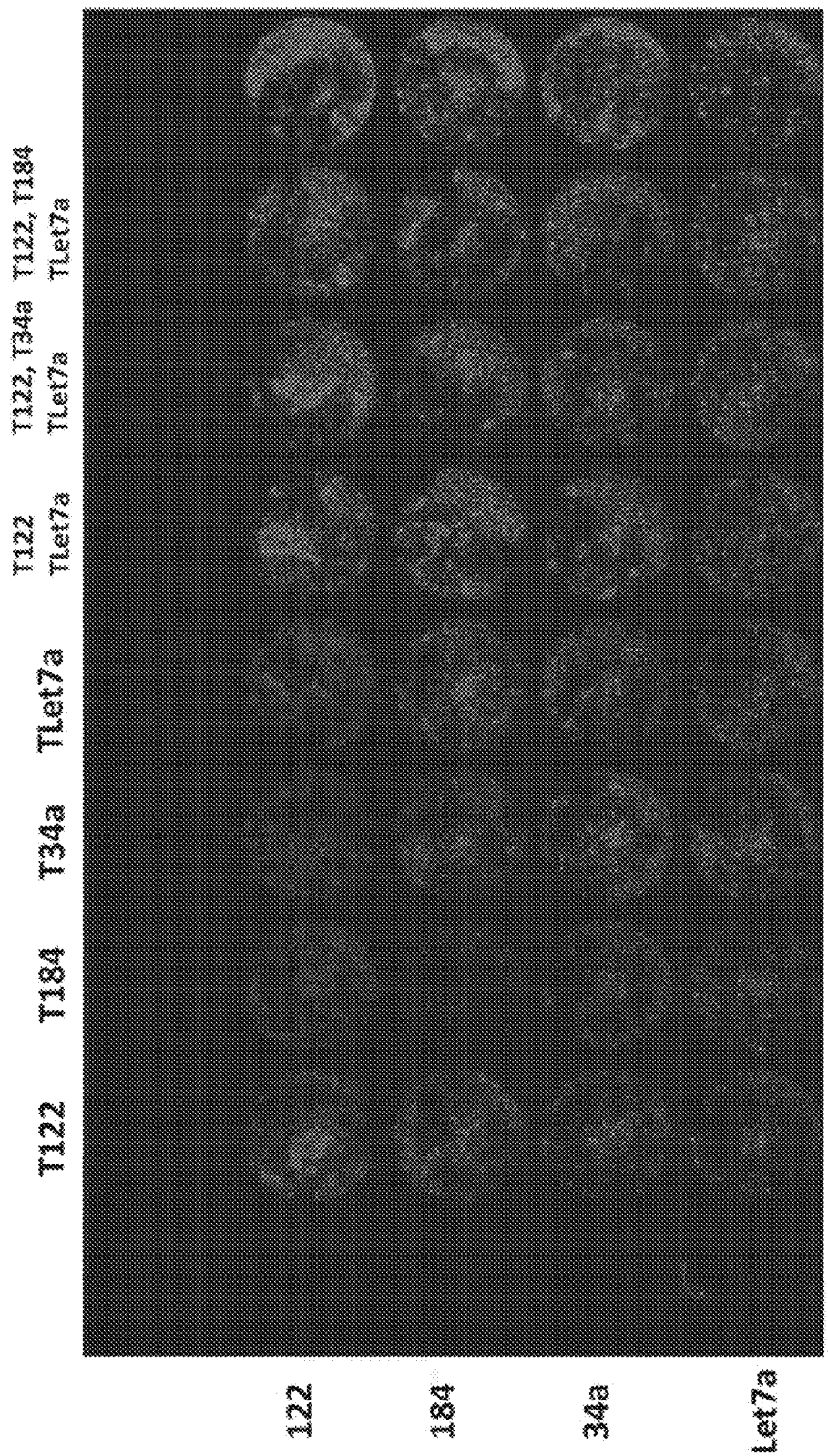
FIG. 13 illustrates expression of miR-122, miR-184, miR-34a, and Let7a, indicated by mCherry expression, using the reporter system shown in FIG. 10 and described in Example 2.
Figure 14:
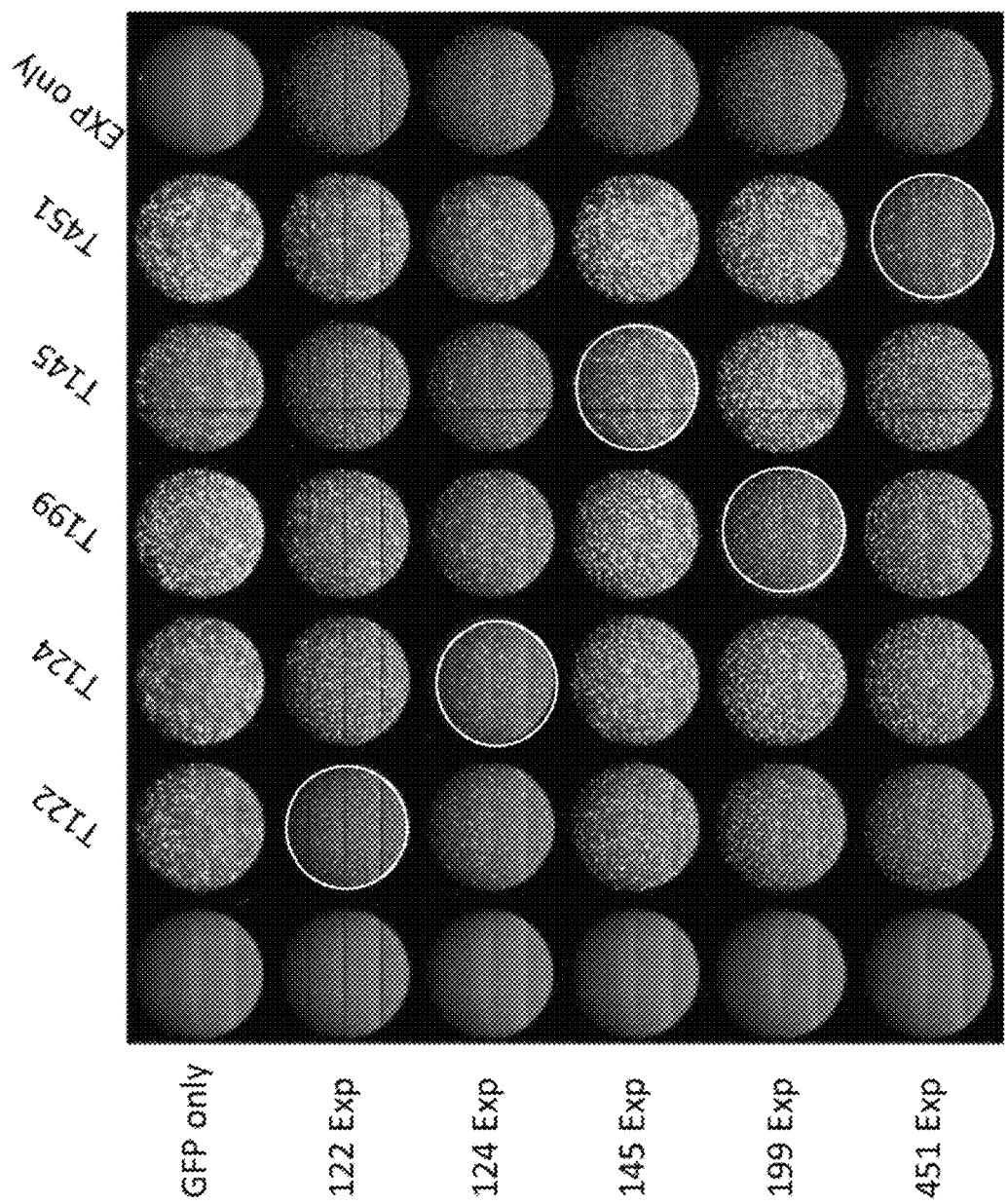
FIG. 14 illustrates miR-122, miR-124, miR-145, miR-199, and miR-451-mediated GFP attenuation using the reporter system shown in FIG. 10 and described in Example 2. Circled wells indicate reduced GFP expression levels.
Figure 15:
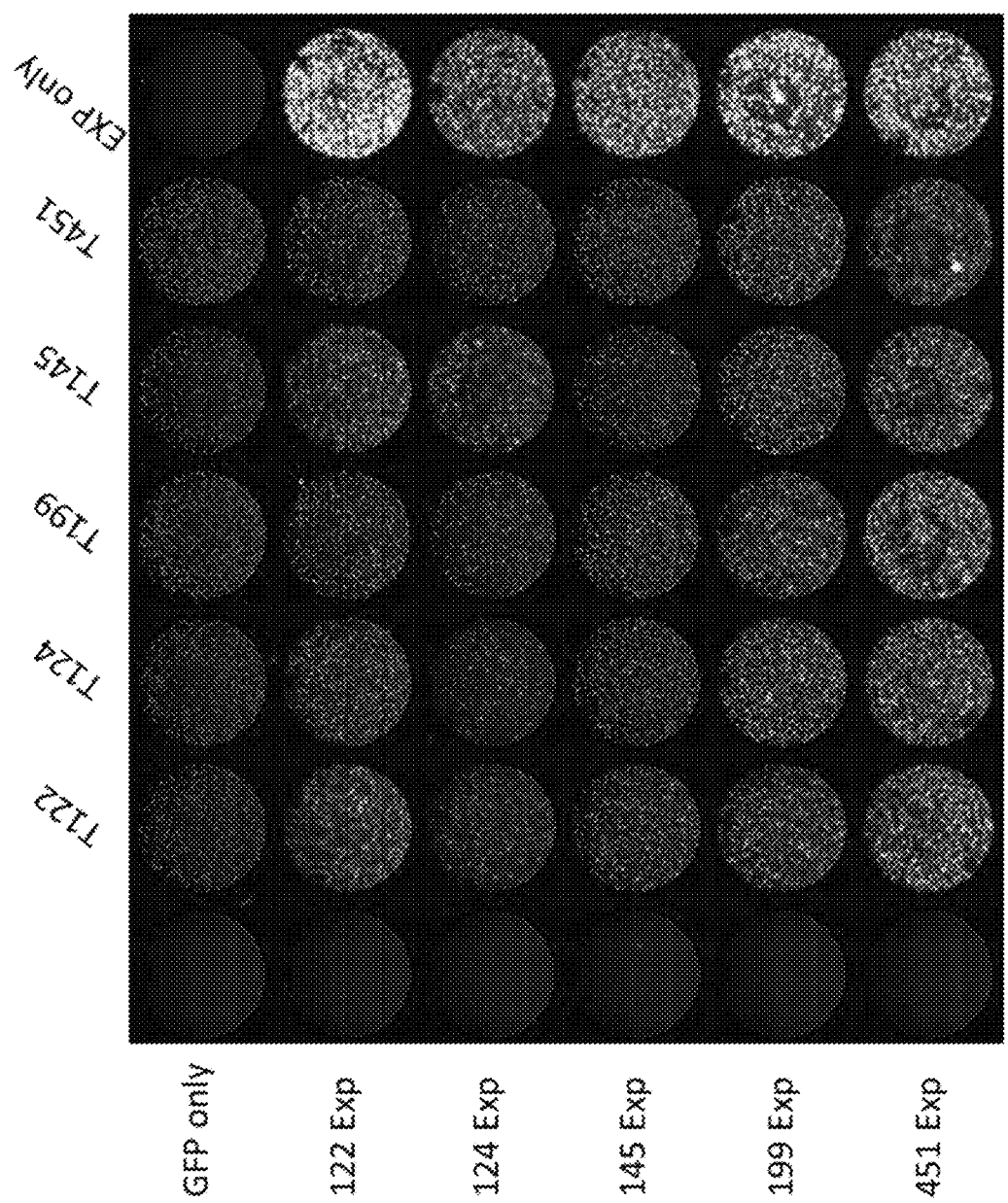
FIG. 15 illustrates expression of miR-122, miR-124, miR-145, miR-199, and miR-451, indicated by mCherry expression, using the reporter system shown in FIG. 10 and described in Example 2.
Figure 17:
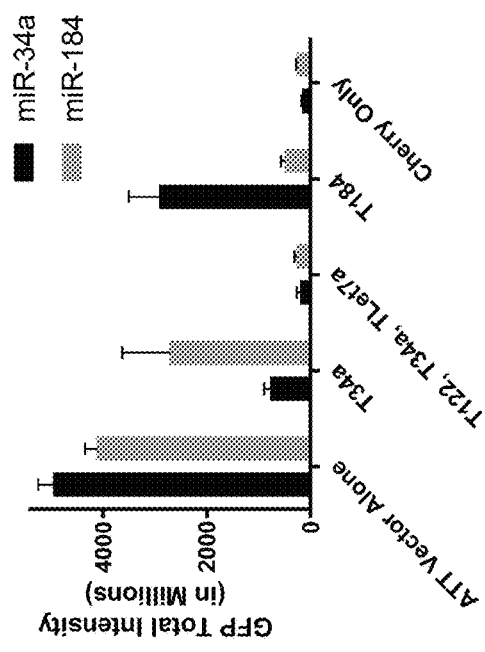
FIG. 17 shows quantitation of miR-34a and miR-184-attenuated GFP fluorescence.
Figure 16:
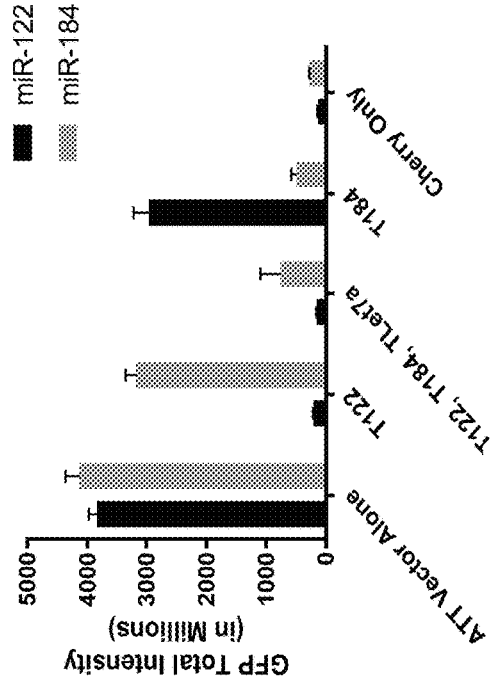
FIG. 16 shows quantitation of miR-122 and miR-184-attenuated GFP fluorescence.
Figure 18:
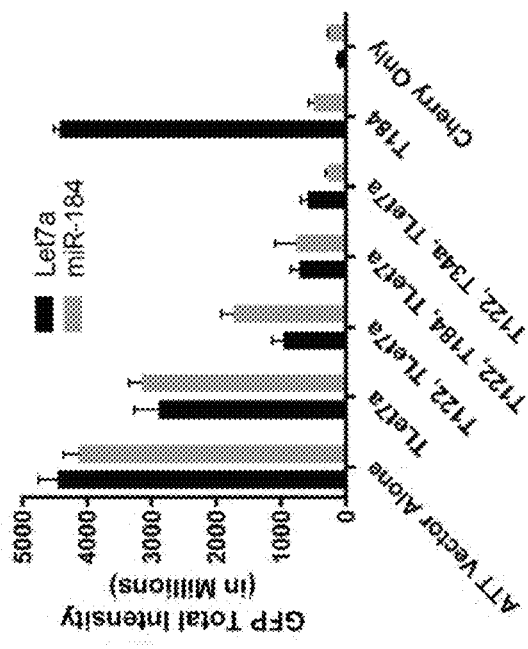
FIG. 18 shows quantitation of Let7a and miR-184-attenuated GFP fluorescence.
Figure 20:
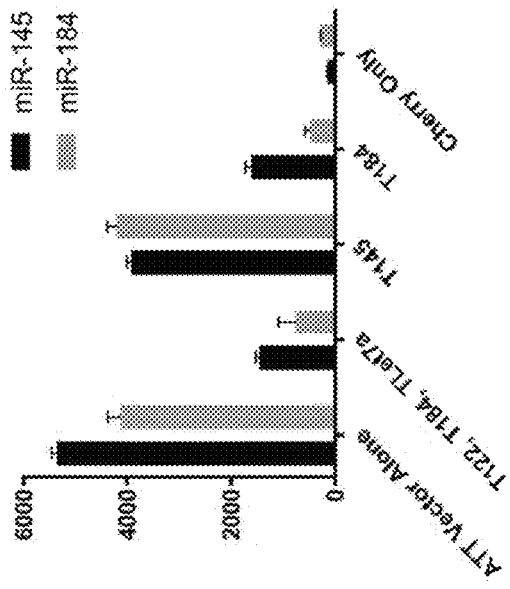
FIG. 20 shows quantitation of miR-145 and miR-184-attenuated GFP fluorescence.
Figure 19:
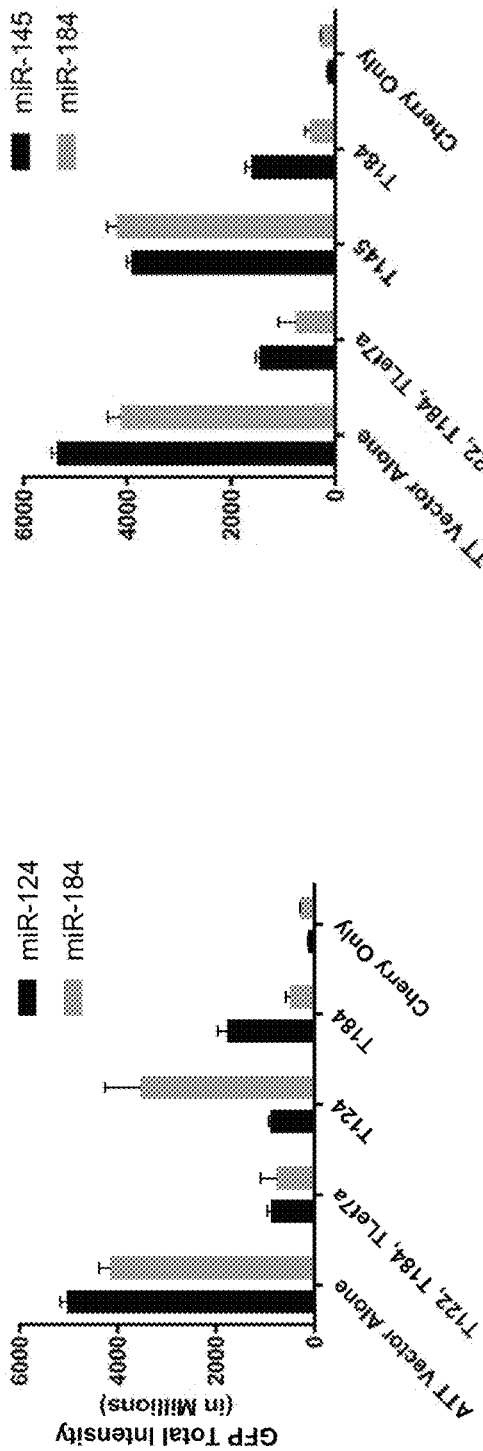
FIG. 19 shows quantitation of miR-124 and miR-184-attenuated GFP fluorescence.
Figure 21:
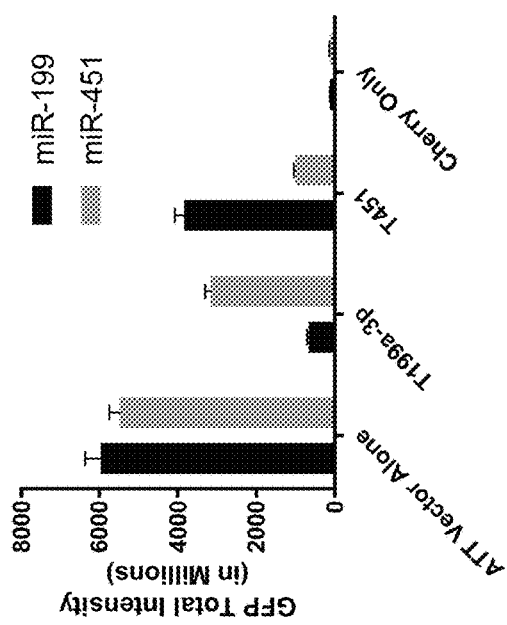
FIG. 21 shows quantitation of miR-199 and miR-451-attenuated GFP fluorescence.
Figure 22:
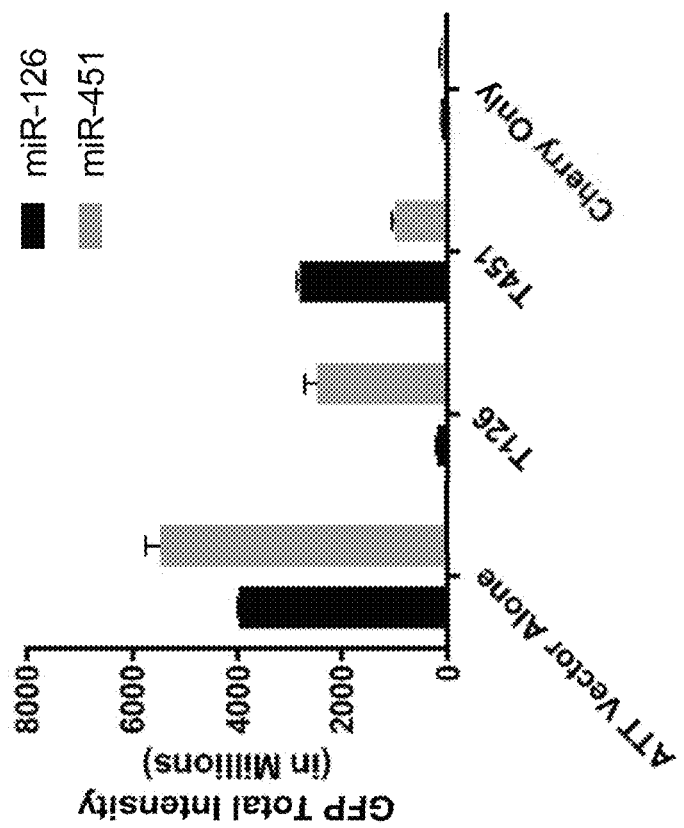
FIG. 22 shows quantitation of miR-125 and miR-451-attenuated GFP fluorescence.
Figure 23:
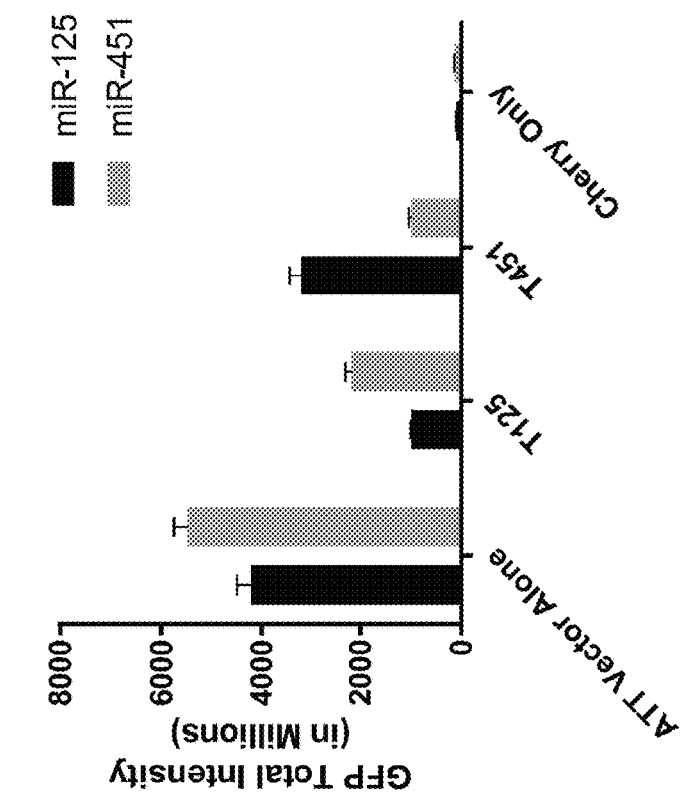
FIG. 23 shows quantitation of miR-126 and miR-451-attenuated GFP fluorescence.

FIG. 11 exemplifies miR-122 mediated attenuation of GFP expression upon induction of miR-122 expression via tet at 24 hours. The control miRNA mimics, miR-184, miR-34a, and Let7a, do not attenuate GFP levels, nor is GFP attenuation observed in the absence of tet. FIG. 12 shows the effect of miR-122, miR-184, miR-34a, and Let7a mimics on attenuation of GFP cassettes with miR-TS cassettes comprising each miR target sequence individually and in cassette combinations of miR-122/Let7a, miR-122/Let7a/miR-34a, or miR-122/Let7a/miR-184. Decreased GFP is only observed when the appropriate miR and cognate target sequence are present together (circled wells). FIG. 13 serves as a non-attenuated control and shows mCherry expression as a measure of the expression of the miR-122, miR-184, miR-34a, and Let7a mimics. FIG. 14 shows the effects of miR-122, miR-124, miR-145, miR-199, and miR-451 mimic expression on attenuated-GFP cassettes with miR-TS cassettes comprising each miR target sequence individually (circled wells). Non-attenuated controls are shown in FIG. 15 and show miR-122, miR-124, miR-145, miR-199, and miR-451 expression and mCherry expression using each target sequence individually.

The ability of additional combinations of miR target sequence to attenuate GFP expression in the presence of cognate miR mimics are shown in FIG. 16-FIG. 26. In each figure, GFP fluorescence is measured at 72 hours post-transfection. In each instance, insertion of the indicated miR target sequences resulted in attenuated GFP expression when the cognate miRs were also expression. The effects of insertion of miR-122 and miR-184 target sequences (FIG. 16), miR-34a and miR-184 target sequences (FIG. 17), Let-7a and miR-184 target sequences (FIG. 18), miR-124 and miR-184 target sequences (FIG. 19), miR-145 and miR-184 target sequences (FIG. 20), miR-199 and miR-451 target sequences (FIG. 21), miR-125 and miR-451 target sequences (FIG. 22), miR-126 and miR-451 target sequences (FIG. 23), miR-127 and miR-451 target sequences (FIG. 24), miR-133 and miR-451 target sequences (FIG. 25), and miR-223 and miR-451 target sequences (FIG. 26) are each shown.

As such, these data indicate that miR expression can result in the specific attenuation of genes expressing the cognate miR target sequence.

Example 4—Generation of miRNA-Attenuated HSV

Following reporter gene-based validation of miRNA target sequences and cognate miRNA pairs, HSV-based viruses comprising miR-TS cassettes were generated. A series of modifications were made in KOS-37 BAC, a full-length genomic clone of the KOS strain of HSV-1 on a bacterial artificial chromosome (BAC) as described (Mazzacurati et al., Mol Ther., 2015). The product, $KG^{BAC}$, was deleted for the internal repeat (joint) region containing one copy each of the diploid genes ICP0, ICP34.5, LAT and ICP4 along with the promoter for the ICP47 gene. This deletion facilitates manipulation of the remaining copies of the 4 deleted genes, provides abundant space for the potential incorporation of transgenes that enhance the oncolytic activity of the virus, and increases tumor specificity by reducing expression of the neurovirulence factor ICP34.5; elimination of ICP47 expression benefits immune recognition of infected cancer cells by virus-specific T cells. $KG^{BAC}$ also contains the GFP open reading frame (ORF) fused to the glycoprotein C (gC) ORF via a 2A peptide sequence to allow monitoring of late (post-replication) viral gene expression. Lastly, $KG^{BAC}$ contains a pair of mutations in the gB gene shown to enhance HSV entry through non-canonical receptors (See e.g., International PCT Publication No. WO 2011/130749). A miR-TS cassette comprising 4 repeats of a target sequence for miR-124-3p were recombined into the 3' UTR of ICP4 to generate the 2A5B vector See e.g., International PCT Publication No. WO 2015/066042), and an expression cassette for MMP9 was inserted into the intergenic region between the UL3 and UL4 genes to generate the 2A5B-MMP9 vector (ONCR-003). Additional miRNA target sequence cassettes were recombined into the 3' UTR of the ICP4, ICP27, UL8, UL42, and/or ICP34.5 genes of ONCR-003 to generate the constructs shown in Table 13 below. All BAC constructs were converted to virus particles with simultaneous removal of the BAC sequences located between loxP sites by transfection of Vero-Cre cells. Following plaque purification, virus stocks were prepared and titered on Vero cells.

TABLE 13

Exemplary miRNA-attenuated HSV constructs

| Construct | ICP27 | UL8 | ICP34.5 | ICP4 | UL42 |
|---|---|---|---|---|---|
| ONCR-003 | None | X | X | 124-3p (4x) | X |
| ONCR-010 | 122-5p<br>34a-5p<br>Let-7a-5p | X | X | 124-3p (4x) | X |
| ONCR-011 | 125a-5p (1x) | X | X | 124-3p (4x) | X |
| ONCR-012 | 143-3p (1x) | X | X | 124-3p (4x) | X |
| ONCR-013 | 145-5p (1x) | X | X | 124-3p (4x) | X |
| ONCR-014 | 199a-5p (1x) | X | X | 124-3p (4x) | X |
| ONCR-015 | 1-3p (1x) | X | X | 124-3p (4x) | X |
| ONCR-016 | 133a-3p (1x) | X | X | 124-3p (4x) | X |
| ONCR-017 | 223-3p (1x) | X | X | 124-3p (4x) | X |
| ONCR-018 | 451a# (1x) | X | X | 124-3p (4x) | X |
| ONCR-019 | 126-3p (1x) | X | X | 124-3p (4x) | X |
| ONCR-020 | 127a-3p (1x) | X | X | 124-3p (4x) | X |
| ONCR-021 | 133b-3p (1x) | X | X | 124-3p (4x) | X |
| ONCR-022 | 134-3p (1x) | X | X | 124-3p (4x) | X |
| ONCR-030 | 199a-3p (1x) | X | X | 124-3p (4x) | X |
| ONCR-035 | 214-3p (1x) | X | X | 124-3p (4x) | X |
| ONCR-036 | 122-5p (1x) | X | X | 124-3p (4x) | X |
| ONCR-039 | 122-5p (2x) | X | X | 124-3p (4x) | X |
| ONCR-040 | 122-5p (3x) | X | X | 124-3p (4x) | X |
| ONCR-043 | 137-3p | X | X | 124-3p (4x) | X |
| ONCR-047 | 34a-5p | X | X | 124-3p (4x) | X |
| ONCR-048 | 184-3p | X | X | 124-3p (4x) | X |
| ONCR-053 | Let7a-5p | X | X | 124-3p (4x) | X |
| ONCR-054 | 122-5p<br>184-3p<br>Let-7a-5p | X | X | 124-3p (4x) | X |
| ONCR-055 | 145-3p | X | X | 124-3p (4x) | X |
| ONCR-062 | 559-5p | X | X | 124-3p (4x) | X |
| ONCR-063 | 122-5p | X | X | 124-3p (4x) | X |
| ONCR-064 | 122-5p<br>Let-7a-5p | X | X | 124-3p (4x) | X |
| ONCR-081 | X | X | X | 124-3p (4x) | 125a-5p (1x) |
| ONCR-082 | X | X | X | 124-3p (4x) | 125a-5p (2x) |
| ONCR-083 | X | X | X | 124-3p (4x) | 125a-5p (3x) |
| ONCR-084 | X | X | X | 124-3p (4x) | 125a-5p (4x) |
| ONCR-092 | 122-5p (1x) | X | X | 124-3p (4x) | 125a-5p (4x) |
| ONCR-093 | 122-5p (4x) | X | X | 124-3p (4x) | 125a-5p (1x) |
| ONCR-094 | 122-5p (1x) | X | X | 124-3p (4x) | 125a-5p (1x) |
| ONCR-095 | 122-5p (1x) | X | X | 124-3p (4x) | 125a-5p (3x) |
| ONCR-096 | 122-5p (4x) | X | X | 124-3p (4x) | 125a-5p (4x) |
| ONCR-098 | 1-3p | X | X | 124-3p (4x) | X |
| ONCR-099 | 145-5p<br>199a-5p<br>559-5p | | | | |
| ONCR-100 | X | X | X | 124-3p (4x) | 122-5p (3x) |
| ONCR-103 | 122-5p (3x) | X | X | 124-3p (4x) | 125a-5p (1x) |
| ONCR-104 | 122-5p (3x) | X | X | 124-3p (4x) | 125a-5p (4x) |
| ONCR-129 | 219a-5p (4x) | X | X | 124-3p (4x), | X |
| ONCR-144 | 122-5p (4x)<br>128-3p (4x) | | | 1-3p (4x),<br>143-3p (4x) | |
| ONCR-130 | 219a-5p (4x)<br>122-5p (4x)<br>128-3p (4x) | X | X | 124-3p (4x) | X |
| ONCR-131 | 219a-5p (4x) | 137-3p (4x) | X | 124-3p (4x), | X |
| ONCR-136 | 122-5p (4x) | 208b-3p (4x) | | 1-3p (4x), | |
| ONCR-155 | 128-3p (4x) | 126-3p (4x) | | 143-3p (4x) | |
| ONCR-132 | X | 137-3p (4x)<br>208b-3p (4x)<br>126-3p (4x) | X | 124-3p (4x) | X | miR-451a is non-canonically processed by Ago2 and does not have -3p and -5p arms

Example 5—Viral Infectivity Assay Using miRNA-Attenuated HSV

To assay for viral infectivity and replication in normal and cancerous cells, miRNA-attenuated HSV particles were tested in the following in vitro assay. On day one, for each cell type infected, HSV particles were introduced to achieve a multiplicity of infection (moi) of 0.01. On days two through five, viral infectivity was assayed by GFP detection using a SpectraMax® i3x Minimax multi-mode microplate reader (Molecular Devices) and analyzed using Softmax Pro or Metamorph imaging software (Molecular Devices). Phase images were acquired with an exposure of 5-6 ms. Fluorescence images were acquired with a GFP (541 nm channel) exposure of 10 ms and an mCherry (713 nm channel) exposure of 200-1500 ms to evaluated any potential non-specific autofluorescence signal.

Figure 27B:
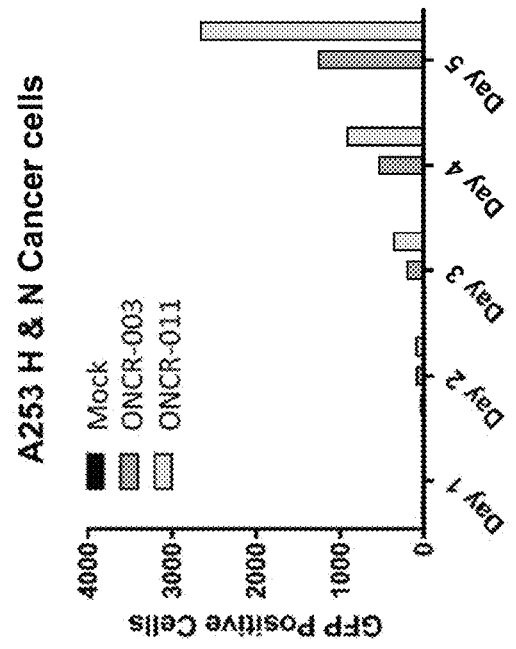
FIG. 27A-FIG. 27D illustrate fluorescence-based quantitation of HSV attenuation by miR-125 in non-cancerous post-mitotic lung cells and cancerous A253 cells.
Figure 27D:
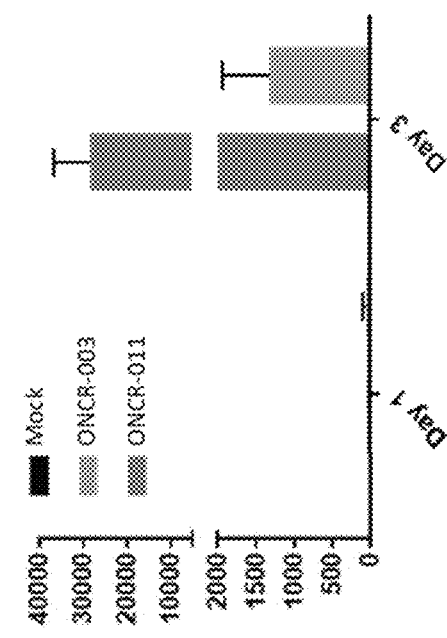
Figure 27A:
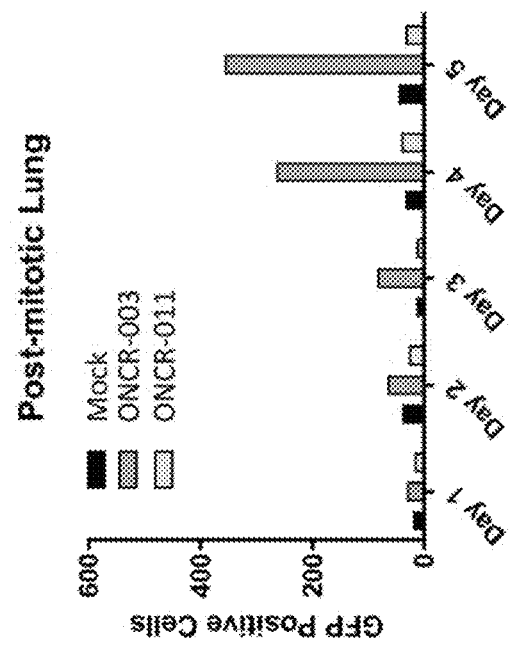
Figure 27C:
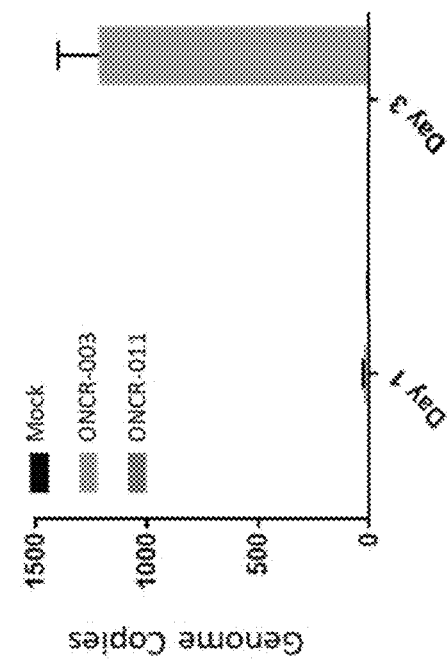

ONCR-011 replication was significantly attenuated in post-mitotic lung tissue due to the presence of the miR-T125 cassette in the ICP27 gene and high levels of miR-125a (>3000 counts, Table 14 below) in these cells, as shown in FIG. 27A (read out by GFP positive cell quantitation) and FIG. 27C (read out by quantitative PCR). Although ONCR-011 and the control virus, ONCR-003, contain miR-124 target sequences in the ICP4 gene, miR-124 is present at low levels (<100 counts, Table 14 below) which were insufficient to attenuate viral replication (FIG. 27B and FIG. 27D). Both ONCR-011 and ONCR-003 replicated freely in head and neck cancer cells (A253) because these cells contain low levels of both miR-125a and miR-124 (<100 counts) (Table 14).

TABLE 14 miR-125a and miR-124 counts in post-mitotic lung and A253 cells

| Cell | miRNA 125a counts | miRNA 124 counts |
| --- | --- | --- |
| PM-lung | >3000 | <100 |
| H&N CA | <100 | <100 |

Figure 28B:
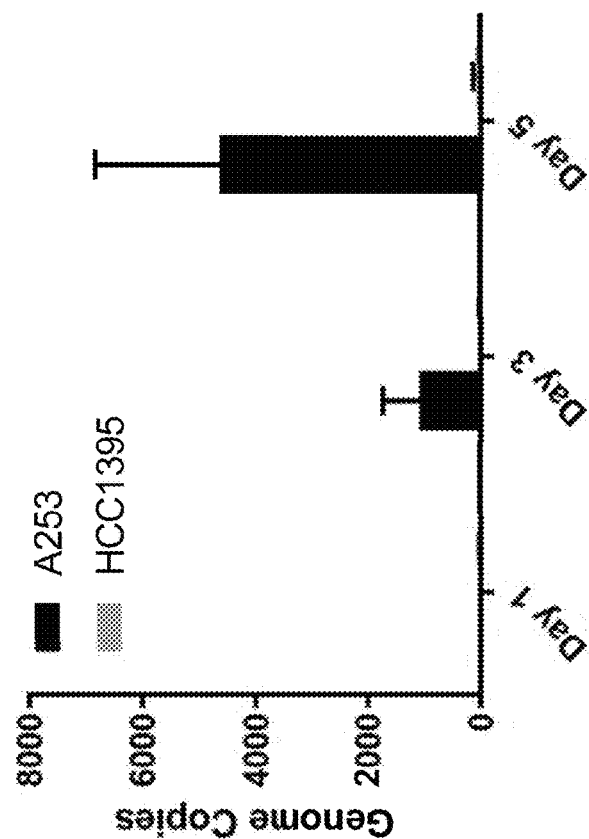
FIG. 28A-FIG. 28B illustrate fluorescence-based (FIG. 28A) and qPCR-based (FIG. 28B) quantitation of HSV attenuation by miR-145 in HCC1395 vs. A253 cells.
Figure 28A:
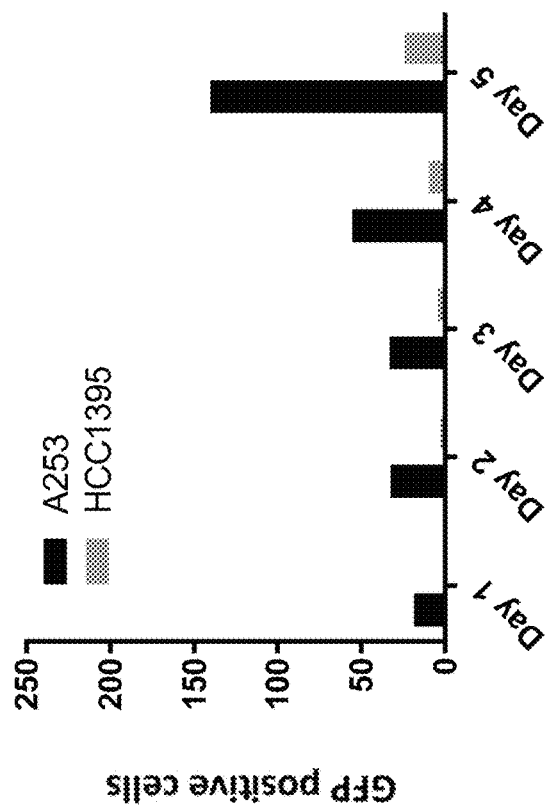

FIG. 28 shows replication of a miR-145 attenuated construct, ONCR-013, in HCC1395 and A253 cells. As shown in FIG. 28A (read out by GFP positive cell quantitation) and FIG. 28B (read out by quantitative PCR), replication of ONCR-013 was significantly attenuated in HCC1395 cells, but not in A253 cells due to the high expression of miR-145 in A253 and absence of expression in HCC1395 cells (Table 15).

TABLE 15 miR-145 counts in A253 and HCC1395 cells

| Cell | miRNA 145 counts |
| --- | --- |
| A253 | 0 |
| HCC1395 | 4487 |

Figure 29B:
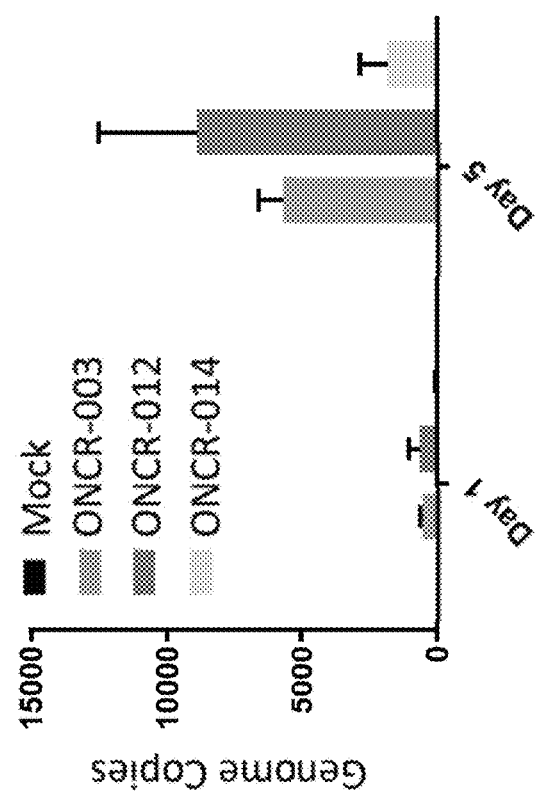
FIG. 29A-FIG. 29B illustrates fluorescence-based (FIG. 29A) and qPCR-based (FIG. 29B) quantitation of HSV attenuation by miR-199a-5p vs. miR-143-3p in normal lung cells.
Figure 29A:
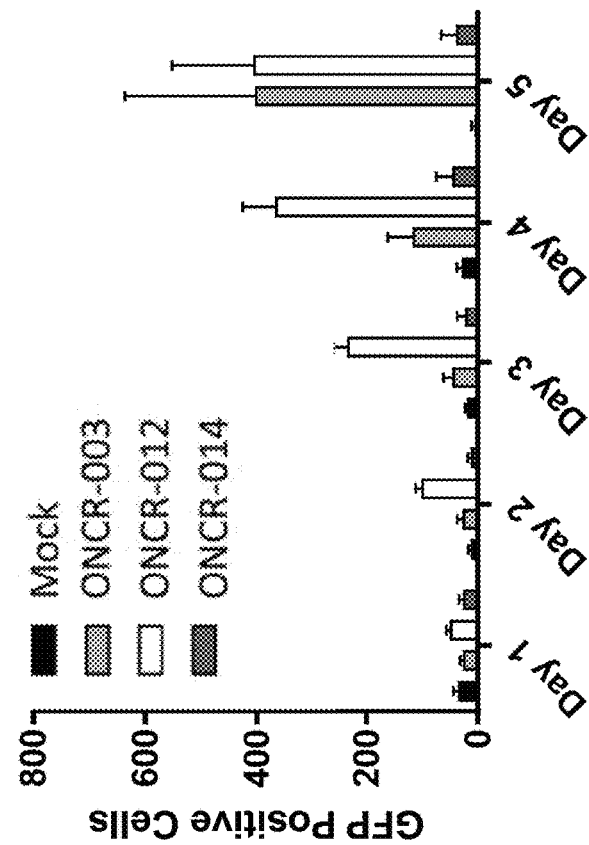

FIG. 29 shows attenuation of a miR-143-3p attenuated construct (ONCR-012) and a miR-199a-5p attenuated construct (ONCR-014) in normal BEAS-2B lung cells. As shown, replication of ONCR-014 was significantly attenuated in non-cancerous lung tissue (FIG. 29A, read out by GFP positive cell quantitation and FIG. 29B, read out by quantitative PCR), indicating that miR-199a-5p target sequences can attenuate viral replication in normal lung cells.

Example 6—Attenuated Replication of oHSV Comprising Multiple miRNA Target Sequences in Multiple Gene Loci Viral infectivity and replication of constructs comprising miR-TS cassettes in multiple genetic loci was assessed in A253, Hep3B, and Huh7 cells. Results for ONCR-036, ONCR-063, ONCR-093, ONCR-094, ONCR-095, and ONCR-096 miR-attenuated HSV constructs are provided herein. Each of these viruses comprised one or more miR-124 target sequences, one or more miR-122 target sequences, and/or one or more miR-125a target sequences inserted into the ICP4, ICP27 and/or UL42 loci. Expression of miR-122 and miR-125a in each of the cell lines was assessed by a TaqMan assay. Briefly, total RNA, including the small RNA fraction, were isolated from growing cells with miRNeasy columns. The RNA was then used as the substrate for miR-122 and miR-125 specific TaqMan assays, and a parallel TaqMan assay for the U6 snRNA was performed to normalize expression levels per cell type per the $\Delta\Delta CT$ method. The data are represented as a fold change relative to lowest cell line in question in each assay (A253 cells, FIG. 30A; Hep3B, FIG. 30B). As shown, A253 cells do not express miR-122 or miR-125a. Hep3B cells express high levels of miR-125 and low levels of miR-122, and Huh7 cells express miR-125a and high levels of miR-122.

Viral infectivity and replication was assessed in an in vitro assay. Briefly, cells were plated at 45,000 cells/well in a 48-well dish and cultured overnight. On day one HSV particles were introduced into each cell type to achieve a multiplicity of infection (moi) of 0.01. 48 hours post-infection, viral infectivity was assessed by fluorescence microscopy. The results of this experiment are shown in FIG. 30C, and viral replication is indicated by eGFP levels. These data demonstrate enhanced attenuation of viral replication in cells that express intermediate to high levels of both miR-122 and miR-125a (Huh7 cells) compared to the attenuation observed in cells that express only one of the cognate miRs (Hep3B, expressing high levels of miR-125a) or compared to cells that express neither cognate miR (A253 cell, expressing neither miR-125a nor miR-122).

Viral spread and protein expression were also assessed. Briefly, cell lysates were harvested 72 hours post-infection and subjected to PAGE and Western blot analysis. An anti-HSV1 capsid (VP5) antibody was used to monitor viral spread/protein expression and B-actin antibody was used as a loading control. In A253 cells, where there is no miR-125a or miR-122 expression, a level of high viral replication was observed in all of the miR-attenuated viruses (FIG. 31, lanes 3-6) as compared to the non-attenuated control (FIG. 31, ONCR-003 as non-attenuated control). However, viral replication was reduced in Huh7 cells, which express both cognate miRNAs and especially high levels of miR-122. These data exemplify viral attenuation by specific miRs relative to control virus.

Figure 32A:
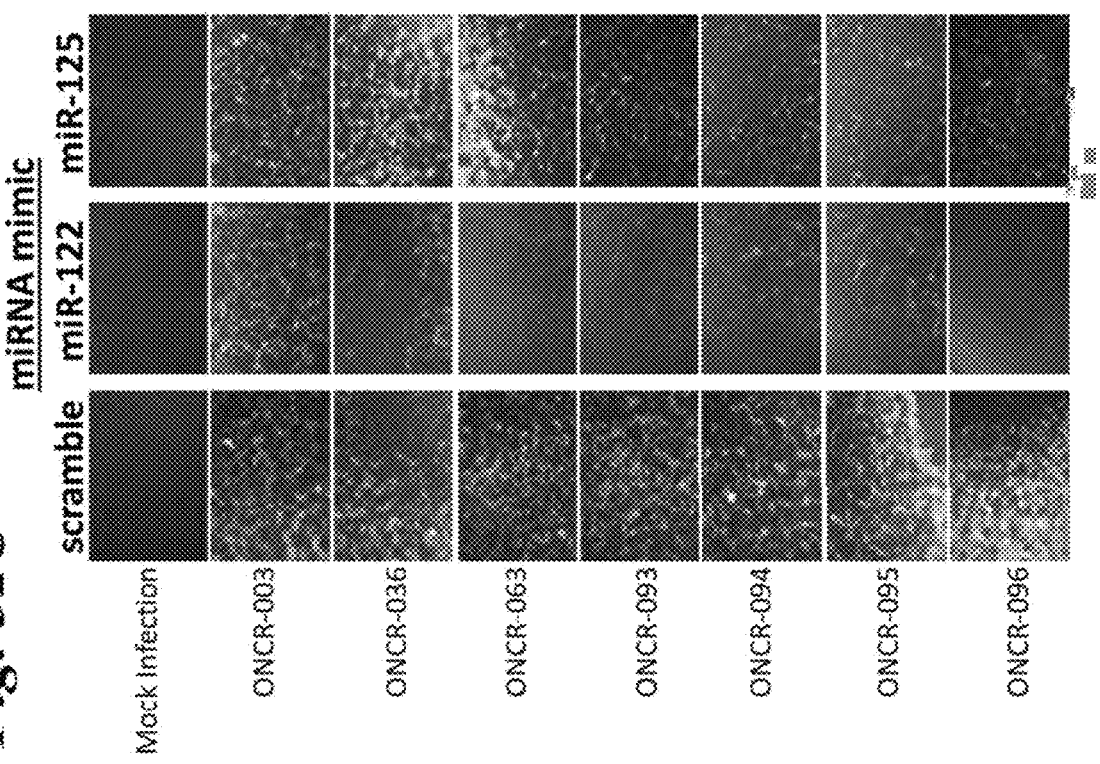
FIG. 32A-FIG. 32D illustrate effects of miRNA expression on miR-attenuated HSV replication.
Figure 32B:
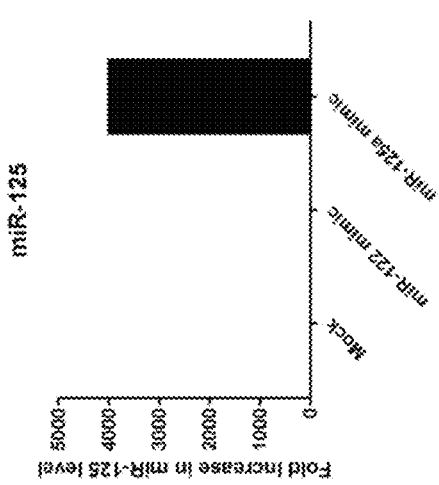

To further confirm that reduced viral replication of miR-attenuated HSV viruses was mediated by expression of specific miRs, A253 cells, which do not express endogenous miR-122 or miR-125a, were transfected with miR-122 and miR-125a mimics. Briefly, A253 cells were plated at 35,000 cells/well in a 48 well dish and cultured overnight. The cells were then transfected with Ambion miRNA mimics at 2.5 pM/well with Lipofectamine RNAiMAX. Total RNA, including the small RNA fraction, were isolated from growing cells with miRNeasy columns. These RNA samples were used as the substrate for miR-122 and miR-125 specific TaqMan assays, and a parallel TaqMan assay for the U6 snRNA was performed to normalize expression levels per cell type per the ΔΔCT method. The results are shown in FIG. 32. As shown in FIG. 32A and FIG. 32B, miR-122 and miR-125 mimics specifically increased intracellular miR-122 and miR-125 expression levels in A253 cells by orders of magnitude.

Figure 32C:
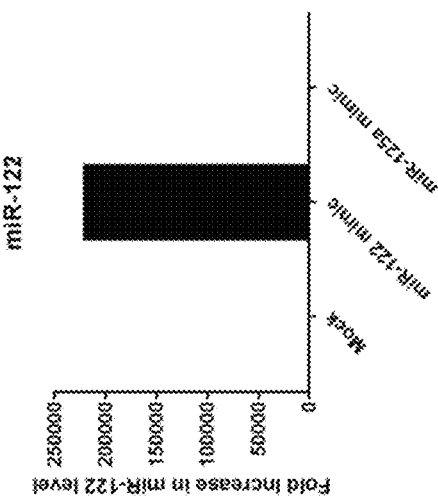
Figure 32D:
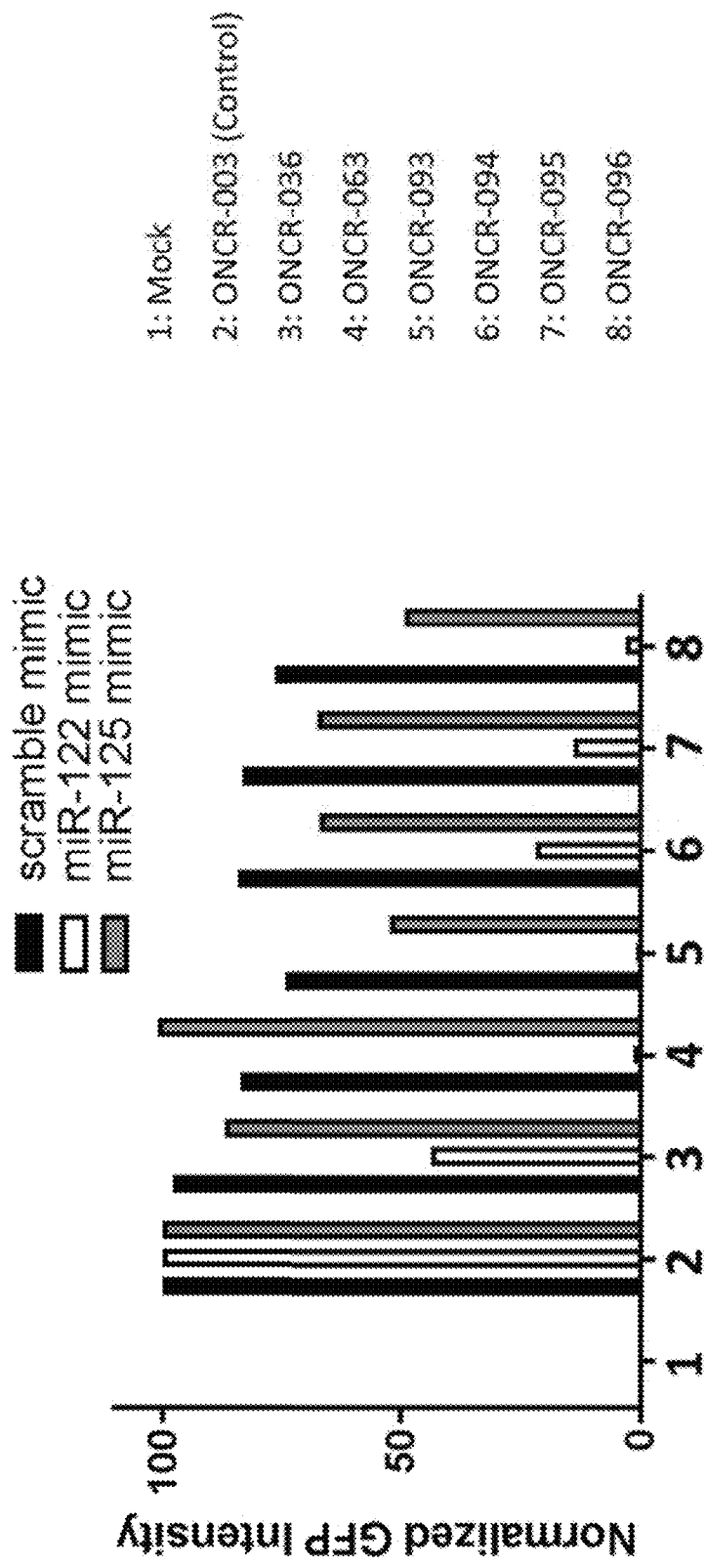
Figure 33:
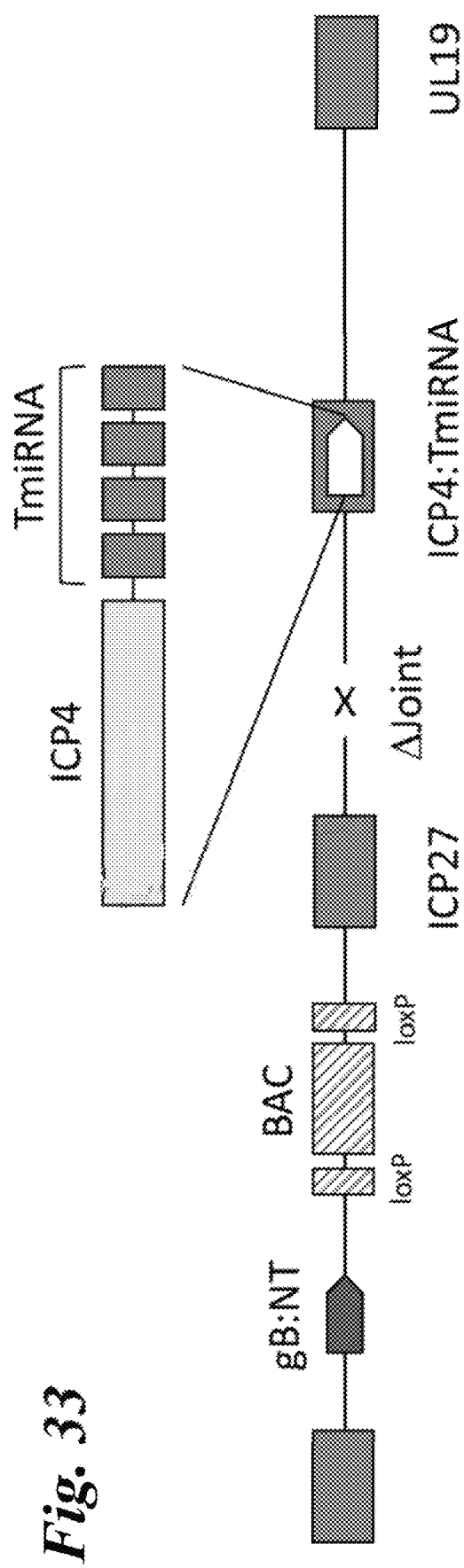
FIG. 33 illustrates a schematic of an ICP4-TmiRNA-attenuated HSV vector for the treatment of cancer or benign hyper-proliferative disorders. gB:NT: virus entry-enhancing double mutation in gB gene; BAC: loxP-flanked choramphenicol-resistance and lacZ sequences; Δjoint: deletion of the complete internal repeat region including one copy of the ICP4 gene; ICP4:TmiRNA: insertion of miRNA target sequences (e.g. let-7, miR-34a, miR-101, miR-125b, miR-145, etc.) into the 3' UTR of the remaining ICP4 gene (also may be placed in 5' UTR)
Figure 34:
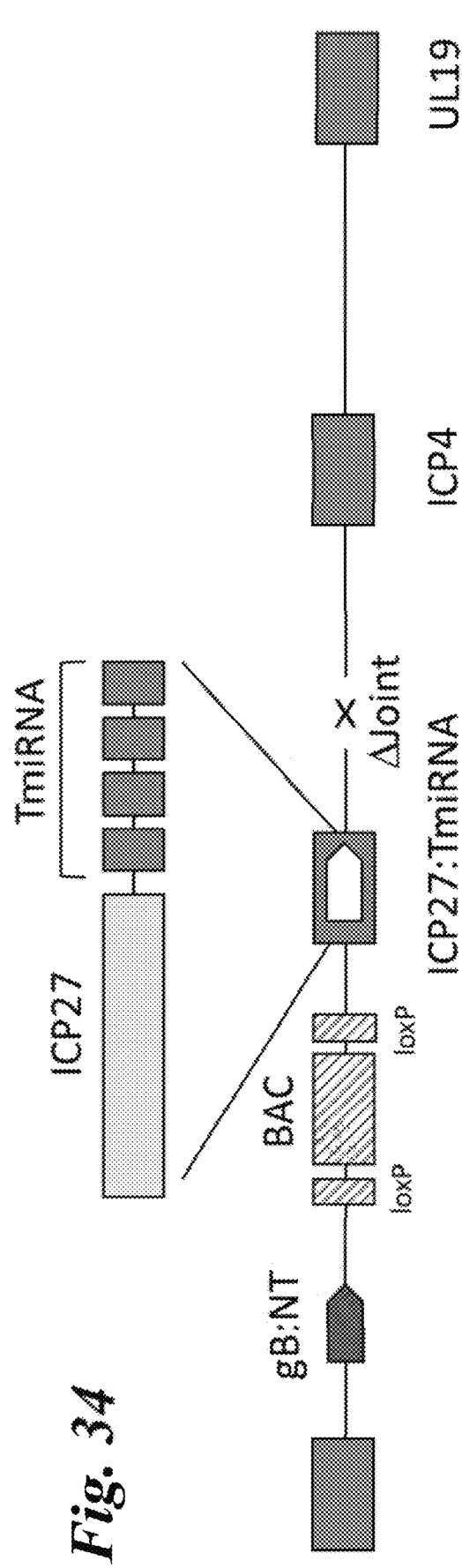
FIG. 34 shows a schematic of an ICP27-TmiRNA-attenuated HSV vector for the treatment of cancer or benign hyper-proliferative disorders. gB:NT: virus entry-enhancing double mutation in gB gene; BAC: loxP-flanked choramphenicol-resistance and lacZ sequences; Δjoint: deletion of the complete internal repeat region including one copy of the ICP4 gene; ICP27:TmiRNA: insertion of miRNA target sequences (e.g. let-7, miR-34a, miR-101, miR-125b, miR-145, etc.) into the 3' UTR of the ICP27 gene (also may be placed in 5' UTR)
Figure 35:
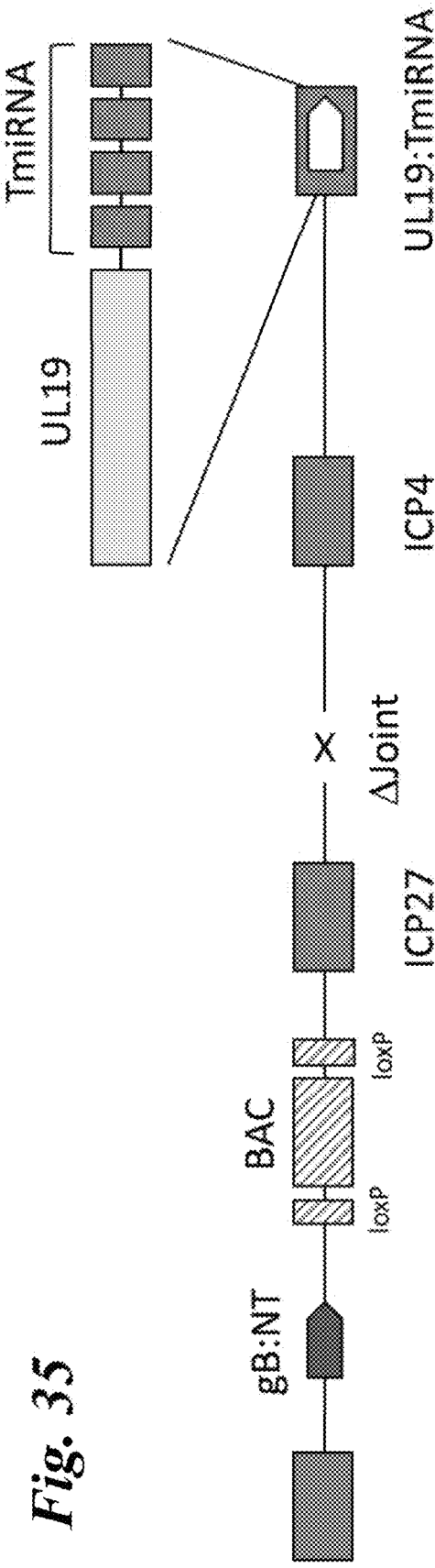
FIG. 35 shows a schematic of a UL19-TmiRNA-attenuated HSV vector for the treatment of cancer or benign hyper-proliferative disorders. gB:NT: virus entry-enhancing double mutation in gB gene; BAC: loxP-flanked choramphenicol-resistance and lacZ sequences; Δjoint: deletion of the complete internal repeat region including one copy of the ICP4 gene; UL19:TmiRNA: insertion of miRNA target sequences (e.g. let-7, miR-34a, miR-101, miR-125b, miR-145, etc.) into the 3' UTR of the UL19 gene (also may be placed in 5' UTR).
Figure 36:
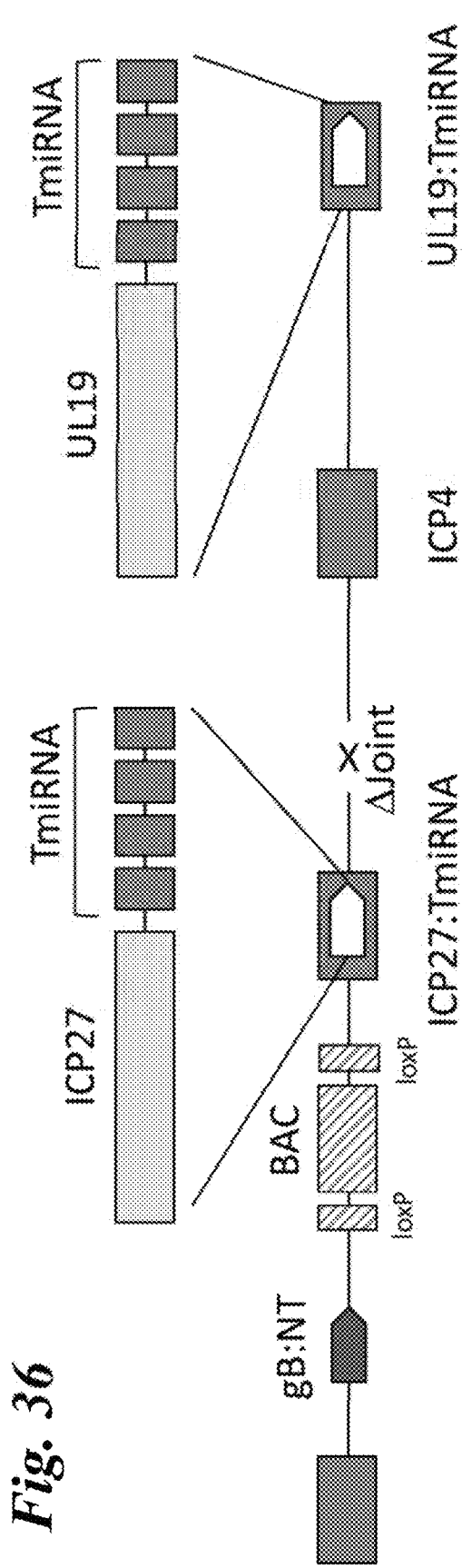
FIG. 36 shows a schematic of an UL19-TmiRNA and ICP27-TmiRNA-attenuated HSV vector for the treatment of cancer or benign hyper-proliferative disorders. gB:NT: virus entry-enhancing double mutation in gB gene; BAC: loxP-flanked choramphenicol-resistance and lacZ sequences; Δjoint: deletion of the complete internal repeat region including one copy of the ICP4 gene; UL19:TmiRNA & ICP27:TmiRNA: insertion of miRNA target sequences (e.g. let-7, miR-34a, miR-101, miR-125b, miR-145, etc.) into the 3' UTR of the UL19 and ICP27 genes (also may be placed in 5' UTR)
Figure 37:
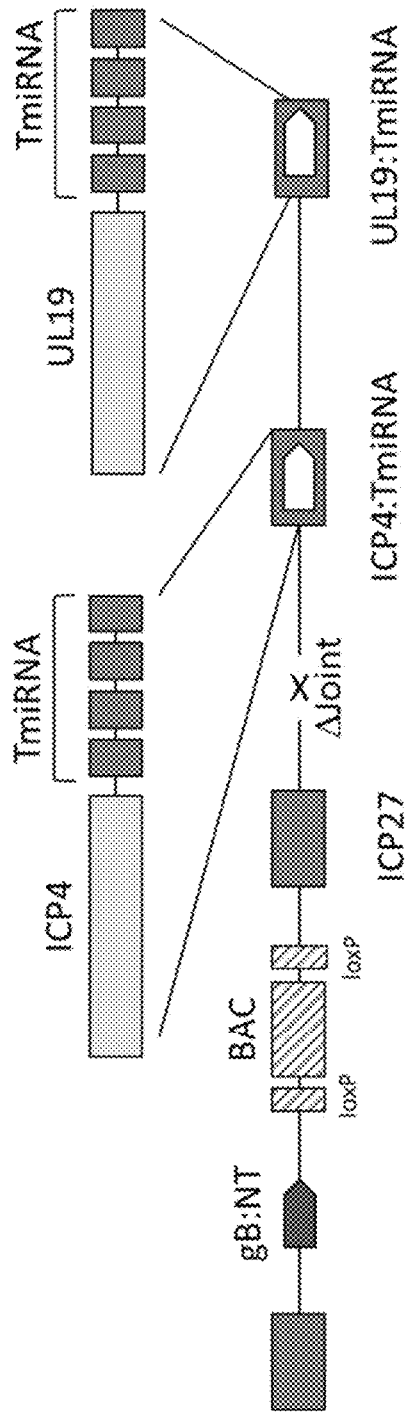
FIG. 37 shows a schematic of an UL19-TmiRNA and ICP4-TmiRNA-attenuated HSV vector for the treatment of cancer or benign hyper-proliferative disorders. gB:NT: virus entry-enhancing double mutation in gB gene; BAC: loxP-flanked choramphenicol-resistance and lacZ sequences; Δjoint: deletion of the complete internal repeat region including one copy of the ICP4 gene; UL19:TmiRNA & ICP4:TmiRNA: insertion of miRNA target sequences (e.g. let-7, miR-34a, miR-101, miR-125b, miR-145, etc.) into the 3' UTR of the UL19 and ICP4 genes (also may be placed in 5' UTR).
Figure 38:
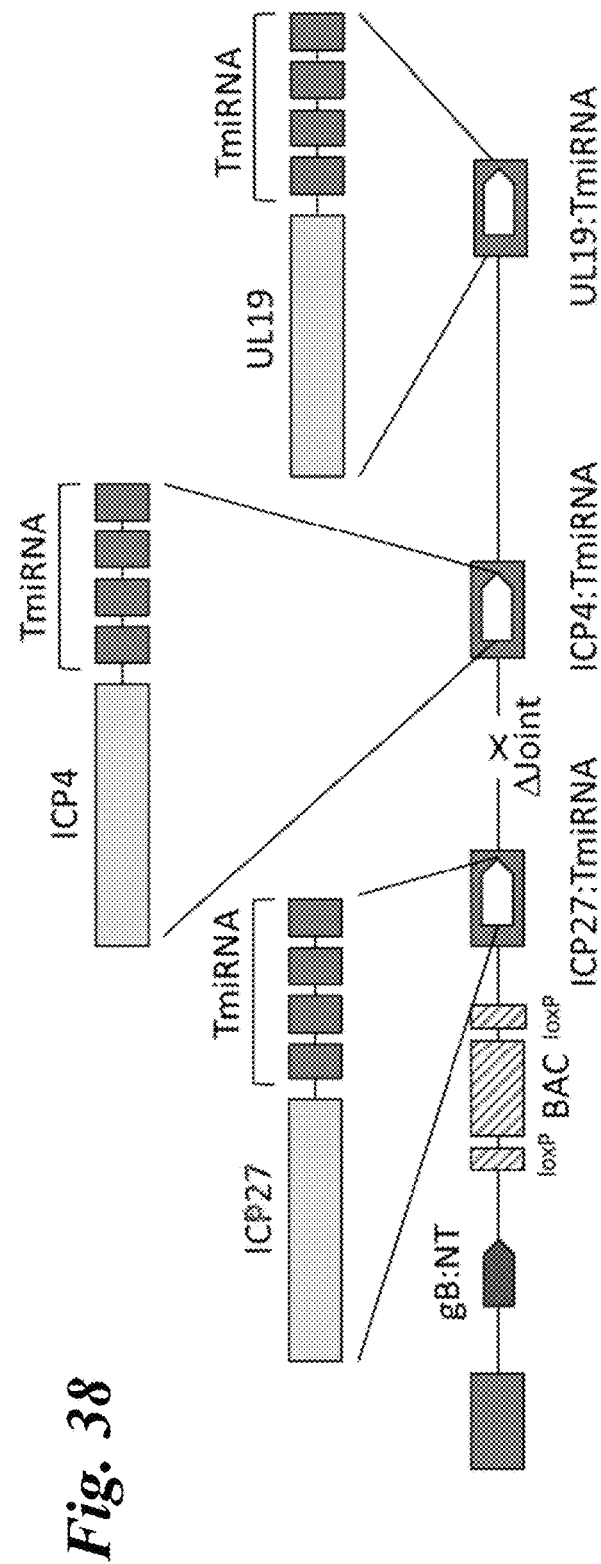
FIG. 38 shows a schematic of an UL19-TmiRNA, ICP27-TmiRNA, and ICP4-TmiRNA-attenuated HSV vector for the treatment of cancer or benign hyper-proliferative disorders. gB:NT: virus entry-enhancing double mutation in gB gene; BAC: loxP-flanked choramphenicol-resistance and lacZ sequences; Δjoint: deletion of the complete internal repeat region including one copy of the ICP4 gene; UL19:TmiRNA, ICP27:TmiRNA, & ICP4:TmiRNA: insertion of miRNA target sequences (e.g. let-7, miR-34a, miR-101, miR-125b, miR-145, etc.) into the 3' UTR of the UL19, ICP27, and ICP4 genes (also may be placed in 5' UTR).

The subsequent day, cells were individually counted and infected with ONCR-036, ONCR-063, ONCR-093, ONCR-094, ONCR-095, or ONCR-096 miR-attenuated HSV particles and ONCR-003 non-attenuated controls at a MOI of 0.01; each of the oHSV viruses were added in 50 µL for 1 hr, followed by addition of complete media. eGFP expressed by productive viral infection was assessed by fluorescence microscopy images taken 48 hrs post-infection. All images were exposed and processed identically. The results of this experiment are shown in FIG. 32C and are quantified by GFP detection using a SpectraMax® i3x Minimax multi-mode microplate reader (Molecular Devices) and analyzed using Softmax Pro in FIG. 32D. These data exemplify attenuated viral replication in the presence of miR-122 mimics for all viruses with the exception of the ONCR-003 (WT). Further, the level of attenuation was proportional to the copy number of miR target sequences present in the HSV constructs, with the greatest reduction in GFP in ONCR-063, ONCR-093, ONCR-096, each comprising 4 miR-122 target sequence repeats in the ICP27 gene. Further, these data exemplify attenuated viral replication in the presence of miR-125a mimics for ONCR-093, -094, -095, and -096, relative to ONCR-003 (WT) and ONCR-036/ONCR-063 (each comprising only miR-122 target sequences).

Similar experiments were performed to assess the viral replication of additional constructs comprising multiple miR-TS cassettes in two or more viral genes (e.g., ONCR-129, ONCR-131, ONCR-125, ONCR-126, ONCR-128, ONCR-130). In each case, expression of one or more miRNAs was able to attenuate viral replication of a particular construct comprising a target sequence corresponding to the expressed miRNA (data not shown).

Example 7—Computational Method for Generating miR-TS Cassettes

Based on the data described in the previous examples, miR-target sequence (miR-TS) cassettes were generated for insertion into particular HSV genes. miR target sequences exhibiting differential expression between cancerous and non-cancerous cells of different tissue types were selected to generate cassettes that are capable of attenuating viral replication in a broad variety of healthy cells, while allowing viral replication in cancerous cells where expression of the cognate miRs is decreased.

This examples illustrates a method of generating candidate miR-TS cassettes and selected preferred candidates from the list. The method, implemented in the computer language Python, is depicted in FIG. 1. The inputs for the method include a list of seeds for exclusion—in this example, seed sequences for miRNAs that are expressed in cancers were excluded—and a list of miR-TSs to include in the cassette. The included miR-TSs used in this example are provided in Table 10, along with the parent miRNA sequence and length in nucleotides (nt) of each. miR-TSs tolerate imperfect matches between the microRNA and the miR-TS, so it will be understood that cassettes can be made with imperfect miR-TSs. miR-TS cassettes can be made with other miR-TSs, include miR-TSs based on any of the microRNAs known in the art or prospectively discovered.

For this example, we designed four miR-TS cassettes, one for each of four essential viral genes: ICP4, ICP27, ICP34.5, and UL8, as shown in Table 16. But in principle these cassettes could be used with other viral (or non-viral) genes. Because the viral genes are in the reverse complementary orientation in our favored vectors, in each case the reverse complementary sequence was used. The abbreviation "miR-126m" refers to a version of the miR-126 site mutagenized to improve the site by removing a seed match for the oncomiR miR-155. The abbreviation "miR-128m" refers to a version of the miR-128 site mutagenized to improve the site by removing a seed match for the oncomiR miR-27a-3p.

TABLE 16

Candidate miR-TS cassettes and target genes

| Cassette | miR-T | HSV gene | Protected Tissue | Indication Specificity |
|---|---|---|---|---|
| 1 | miR-124-3p<br>miR-1-3p<br>miR-143-3p | ICP4 | CNS/Brain/PNS, smooth muscle, striated muscle/ heart | Lung, HnN |
| 2 | miR-128-3p<br>miR-219a-5p<br>miR-122-5p | ICP27 | CNS/Brain/PNS/ oligodend rocytes, liver | Lung, HnN |
| 3 | miR-137-3p<br>miR-208b-3p<br>miR-126-3p | UL8 | CNS/Brain/PNS, heart, vasculature, hematopoietic stem cells | Lung, HnN, Bladder |
| 4 | miR-219a-5p<br>miR-204-5p<br>miR-128-3p | ICP34.5 | Spine, PNS, CNS (Oligodendrocytes, Glial cells, Neurons) | All |

The cassette designed for ICP4 can be used to down-regulate any gene, to which it is operatively linked, in smooth muscle (because of miR-143 target site) and striated muscale (because of miR-1 target site). The cassette designed for ICP27 can be used to down-regulate any gene, to which it is operatively linked, in healthy tissue because of miR-128m (expressed in cortical neurons), miR-122 (expressed in the liver), and miR-219 (expressed in the brain, spine and nerves) target sites. The cassette designed for ICP27 can be used to down-regulate any gene, to which it is operatively linked, in healthy tissue because of miR-128m, miR-204, and miR-219 target sites. The cassette designed for UL8 can be used to down-regulate any gene, to which it is operatively linked, in non-tumor tissue because of the mRNA target sites: miR-217, miR-137, and miR-126m.

The program was run, outputting 10,000-100,000 cassettes for each combination which match the criteria used for list example (each of which is optional): (1) four copies of each miR-TS sites (in reverse-complementary orientation) arranged in a random order; (2) except that the same miR-TS cannot repeat adjacent to itself; (3) separated by 4 nucleotide spacers having random sequence; (4) no seeds from the excluded seed list; and (4) no polyadenylation sequence (AATAAA). The program also can, optionally, add 5' arm (CATGGACGAGCTGTACAAGTAAAGC) and 3' arm (GCGACCGGCTAGCGTACTAGCTTAG) sequences for Gibson assembly cloning (Nat Methods 2009; 6 (5): 343-5).

The program next calculated a delta-G for folding of the candidate sequences using the "fold" subroutine of the ViennaRNA package (Lorenz et al. *Algorithms for Molecular Biology*, 6:1 26, 2011) with a 40 nt sliding window. The values for this sliding window calculation were stored as a list for each candidate sequence, and the candidate sequences are sorted by the maximum value of the absolute values of all delta-G values in the list (i.e., by the folding energy of the strongest secondary-structure element in the RNA). Sequences were further reviewed manually to eliminate candidate sequences with multiple, lower energy minima. Whenever possible, a candidate sequence with no local minima was chosen. In this manner, candidate sequences were identified in which there are no strong RNA secondary structure (low max of abs of delta-G) and also no local minima, or few local minima, in predicted secondary-structure folding energy.

Finally, a microRNA target scanning algorithm (miranda v3.3a) was run on each candidate sequence to ensure that the desired miR-TSs were present and that no undesirable miR-TS were inserted by the program.

Example sequences generated by this method are provided in Table 17. The length of the cassette is defined as the number of nucleotides from the first miR-TS to the last miR-TS, inclusive of the first and last miR-TS. Because the program adds a 5' first spacer of 4 nt and a 3' last space not including the definition of length used herein, the length of the cassette is the length of the sequence output by the program minus 8 nt (=2*4 nt first and last spacer).

TABLE 17

| Cassette | Sequence | SEQ ID | # of miR-TS | Length | Nucleotides/ miR-TS |
|---|---|---|---|---|---|
| miRT-1-143_1736 | ccatatacatacttctttacattccatcctg agctacagtgcttcatctcattgcatacata cttctttacattccaacgtgagctacagtgc ttcatctcatccgatacatacttctttacat tccacggcgagctacagtgcttcatctcacc ttatacatacttctttacattccaaaaagag ctacagtgcttcatctcaccat | 852 | 8 | 200 | 25 |
| miRT-128m-122-219_6793 | cacgagaattgcgtttggacaatcagacaca aacaccattgtcacactccatcttaaagaga ccggttcactgtggatgtcaaacaccattgt cacactccaacttagaattgcgtttggacaa tcaagggaaagagaccggttcactgtggcca gcaaacaccattgtcacactccaaaacaaag agaccggttcactgtggtacgagaattgcgt ttggacaatcagaaaaagagaccggttcac tgtggaatacaaacaccattgtcacactcca acaaagaattgcgtttggacaatcaggtt | 853 | 12 | 300 | 25 |
| miRT-128m-204-219_9304 | aagtaaagagaccggttcactgtggaataag aattgcgtttggacaatcaaggtaggcatag gatgacaaagggaacagcaaagagaccggtt cactgtggggctagaattgcgtttggacaat cacgtaaggcataggatgacaaagggaacga gaaagagaccggttcactgtgggggaagaat tgcgtttggacaatcatactaggcataggat gacaaagggaattagaaagagaccggttcac tgtggatttagaattgcgtttggacaatcat agaaggcataggatgacaaagggaattgt | 854 | 12 | 300 | 25 |
| miRT-217-137-126m_3163 | tatgctacgcgtattcttaagcaataagact tccaatcagttcctgatgcagtacgaccaca ttattactcacggtacgaaagcctacgcgta ttcttaagcaataaccgccacattattactc acggtacgataaatccaatcagttcctgatg cagtaattactacgcgtattcttaagcaata actattccaatcagttcctgatgcagtaccc ccacattattactcacggtacgagaattcca atcagttcctgatgcagtacagtcacattat tactcacggtacgatcaactacgcgtattct taagcaataaccaa | 855 | 12 | 300 | 25 |

The ability of the miR-TS cassettes shown in Table 17 to attenuate viral replication is shown in FIG. 53A-FIG. 53B.

Additional constructs comprising miR-TS cassettes designed with this method are shown in Table 18 were constructed.

TABLE 18

| HSV constructs comprising candidate miR-TS cassettes | | | | | |
|---|---|---|---|---|---|
| Construct | ICP27 | UL8 | ICP34.5 | ICP4 | UL42 |
| ONCR-142 | 219a-5p (4x) | 137-3p (4x) | 128-3p$^M$ (4x) | 124-3p (4x) | X |
| ONCR-154 | 122-5p (4x) | 208b-3p (4x) | 204-5p (4x)$^\Psi$ | 1-3p (4x) | |
| | 128-3p (4x) | 126-3p (4x) | 219a-5p (4x)$^\Psi$ | 143-3p (4x) | |

TABLE 18-continued

HSV constructs comprising candidate miR-TS cassettes

| Construct | ICP27 | UL8 | ICP34.5 | ICP4 | UL42 |
|---|---|---|---|---|---|
| ONCR-156 | 219a-5p (4x)<br>122-5p (4x)<br>128-3p (4x) | 137-3p (4x)<br>208b-3p (4x)<br>126-3p (4x) |  | 124-3p (4x)<br>1-3p (4x)<br>143-3p (4x) | X |
| ONCR-158 | 219a-5p (4x)<br>122-5p (4x)<br>128-3p (4x) | 137-3p (4x)<br>208b-3p (4x)<br>126-3p (4x) | 128-3p$^M$ (4x)<br>204-5p (4x)<br>219a-5p (4x) | 124-3p (4x)<br>1-3p (4x)<br>143-3p (4x) |  |
| ONCR-157 | 219a-5p (4x)<br>122-5p (4x)<br>128-3p (4x) | 137-3p (4x)<br>217-5p (4x)<br>126-3p (4x) | 128-3p$^M$ (4x)<br>204-5p (4x)<br>219a-5p (4x) | 124-3p (4x)<br>1-3p (4x)<br>143-3p (4x) | X |
| ONCR-159<br>ONCR-165<br>ONCR-166<br>ONCR-167<br>ONCR-168<br>ONCR-169<br>ONCR-170<br>ONCR-171<br>ONCR-172<br>ONCR-173<br>ONCR-174<br>ONCR-175<br>ONCR-176<br>ONCR-177 | 219a-5p (4x)<br>122-5p (4x)<br>128-3p (4x) | 137-3p (4x)<br>217-5p (4x)<br>126-3p$^M$ (4x) | 128-3p$^M$ (4x)<br>204-5p (4x)<br>219a-5p (4x) | 124-3p (4x)<br>1-3p (4x)<br>143-3p (4x) | X |
| ONCR-160 | 219a-5p (4x)<br>122-5p (4x)<br>128-3p (4x) | 137-3p (4x)<br>208b-3p (4x)<br>126-3p (4x) | 128-3p$^M$<br>204-5p (4x)$^\Psi$<br>219a-5p (4x)$^\Psi$ | 124-3p (4x)<br>1-3p (4x)<br>143-3p (4x) | X |
| ONCR-161 | 219a-5p (4x)<br>122-5p (4x)<br>128-3p (4x) | 137-3p (4x)<br>208b-3p (4x)<br>127 (4x) | 128-3p$^M$ (4x)<br>204-5p (4x)$^\Psi$<br>219-5p (4x)$^\Psi$ | 124-3p (4x)<br>1-3p (4x)<br>143-3p (4x) | X |
| ONCR-162 | 219a-5p (4x)<br>122-5p (4x)<br>128-3p (4x) | 137-3p (4x)<br>208b-3p (4x)<br>128-3p (4x) | 128-3p$^M$ (4x)<br>204-5p (4x)$^\Psi$<br>219-5p (4x)$^\Psi$ | 124-3p (4x)<br>1-3p (4x)<br>143-3p (4x) | X |
| ONCR-163 | 219a-5p (4x)<br>122-5p (4x)<br>128-3p (4x) | 137-3p (4x)<br>208b-3p (4x)<br>129 (4x) | 128-3p$^M$ (4x)<br>204-5p (4x)$^\Psi$<br>219-5p (4x)$^\Psi$ | 124-3p (4x)<br>1-3p (4x)<br>143-3p (4x) | X |
| ONCR-164 | 219a-5p (4x)<br>122-5p (4x)<br>128-3p (4x) | 137-3p (4x)<br>208b-3p (4x)<br>130 (4x) | 128-3p$^M$ (4x)<br>204-5p (4x)$^\Psi$<br>219-5p (4x)$^\Psi$ | 124-3p (4x)<br>1-3p (4x)<br>143-3p (4x) | X |

$^\Psi$one of the 4 target sequences was non-functional due to cloning error
$^M$comprises a modified target sequence Example 8—Cytotoxicity of miR-Attenuated HSV Constructs Experiments were performed to assess the in vitro cytotoxicity of select miR-attenuated HSV constructs, ONCR-125, ONCR-131, ONCR-142, and ONCR-157. Various cancer cell lines were infected with the indicated constructs at MOIs of 30, 10, 3.33, 1.11, 0.37, 0.12, 0.04, 0.13, 0.0045, and 0.0015 and cell viability was assessed at 72 hours post infection. Cell lines used include the colorectal adenocarcinoma cell lines SW837 and COLO205, the melanoma cell lines SKMEL28 and A375, small cell lung cancer cell line H446, pancreatic adenocarcinoma cell line BXPC3, and the breast cancer cell line BT 549. The IC50 of each construct was calculated and is shown below in Table 19. Results of each of these experiments are shown in FIG. 54A-FIG. 54E.

TABLE 19

|  | ONCR-125 | ONCR-131 | ONCR-142 | ONCR-157 |
|---|---|---|---|---|
| SW837 | 0.07 | 0.04 | 0.05 | 0.07 |
| COLO205 | 0.45 | 0.12 | 0.223 | 0.45 |
| SKMEL28 | 0.12 | 0.04 | 0.12 | 0.25 |
| A375 | 0.87 | 0.26 | 0.89 | 1.5 |
| H446 | 0.13 | 0.05 | 0.15 | 0.15 |
| BXPC3 | 0.08 | 0.002 | 0.08 | 0.07 |
| BT549 | 0.45 | 0.17 | 0.6 | 1.0 |

Example 9—IL-12 Enhances Abscopal Efficacy of HSV

Experiments were performed to assess the effects of IL-12 on the absocpal effect of oncolytic HSV. Briefly, the ONCR-133 construct, comprising an ICP4 miR-TS cassette comprising 4 repeats of miR-124-3p and an expression cassette encoding murine IL-12 was administered to mice in an MC38 tumor model. As shown in FIG. 55, ONCR-133 significantly inhibited tumor growth of injected tumors compared to vehicle treated controls (p<0.0001). ONCR-133 treatment also significantly inhibited tumor growth of non-injected tumors (p<0.005), indicating an enhanced abscopal effect.

Surprisingly, expression of an additional immune-activating payload, ULBP3, did not further enhance the tumor growth inhibition effects of HSV expressing IL-12. As shown in FIG. 56, mice treated with ONCR-133+ONCR-007 (an HSV construct expressing ULBP3) or ONCR-133+ONCR-002 (an HSV construct that does not express any additional payload molecules) both demonstrated a significant inhibition of tumor growth compared to vehicle treated controls. However, there was no added benefit of ULBP3 expression in the inhibition of growth of injected or non-injected tumors. In fact, as shown in the table in FIG. 56, additional expression of ULBP3 slightly decreased the tumor growth inhibition observed with IL-12 expression alone.

Similarly, additional expression of CXCL10 did not further enhance and anti-tumor efficacy of HSV expressing IL-12. Mice treated with ONCR-113 (an HSV construct expressing IL-12 and MMP9)+ONCR-106 (an HSV construct expressing CXCL10 and MMP9) or ONCR-113+ONCR-031 (an HSV construct expressing MMP9). As shown in FIG. 57, the additional expression of CXCL10 in the ONCR-106+ONCR-113 treated group did not enhance the inhibition of tumor growth in either injected or non-injected tumors compared to mice treated with ONCR-031+ONCR-113. In fact, as shown in the table in FIG. 57, additional expression of CXCL10 slightly decreased the tumor growth inhibition in both injected and non-injected tumors.

Example 10—CCL4 Expression Further Enhances Abscopal Efficacy of HSV

Experiments were performed to assess the effects of CCL4 in tumor growth inhibition in the MC38 model described in Example F. Results of this experiment are shown in FIG. 58 and Table 20 below. Mice were treated with one of 4 constructs, ONCR-133 (expressing IL-12), ONCR-151 (expressing IL-12, CXCL10, and XCL1), ONCR-152 (expressing IL-12, CXCL10, and FLT3 ligand), or ONCR-153 (expressing IL-12, CXCL10, and CCL4). As shown in FIG. 58, treatment with all of ONCR-133, -151, -152, and -153 significantly inhibited tumor growth of injected and non-injected tumors compared to vehicle controls. However, mice treated with ONCR-153 demonstrated an increase in tumor growth inhibition in the injected tumors and in the non-injected tumors compared to treatment with ONCR-133, whereas ONCR-151 or -152 demonstrated a slight decrease in efficacy compared to treatment with ONCR-133. These results demonstrate that CCL4 expression can increase the tumor growth inhibition and abscopal effect of oncolytic HSV above the effects observed with IL-12 expression alone.

Tumors from mice treated with ONCR-153 were harvested and assessed for the presence of HSV by RT-PCR analysis of the gD gene. As shown in FIG. 59A and FIG. 59B, HSV was detected in the injected tumors, but not in the non-injected tumors, indicating that the tumor growth inhibition observed in the non-injected tumors was not due to viral spread, but rather the abscopal effects of virus administration. Tumors were also assessed for the presence of the three payloads, IL-12, CXCL10, and CCL4. As shown in FIG. 60A-60C, payload expression peaked in the injected tumors at 24-hours post-treatment and decreased thereafter. Levels of the payloads were also assessed in the serum (FIG. 61A-61C) of mice treated with ONCR-153, where only CXCL10 expression was observed. However, as shown in FIG. 62, treatment of mice with ONCR-153 induced an intra-tumoral IFNγ response in both injected and non-injected tumors (left panel). Similarly, increased expression of IFNγ was observed in the serum of ONCR-153 treated mice. These data further indicate that the combination of IL-12 and CCL4 expression by HSV induce a localized immune response that may contribute to the abscopal effect observed with ONCR-153.

Example 11—FLT3 Expression Further Enhances Abscopal Efficacy of HSV

Experiments were performed to assess the effects of FLT3 in tumor growth inhibition in the MC38 model described in Example F. Results of this experiment are shown in FIG. 63 and Table 21 below. Mice were treated with one of 3 combinations of constructs expressing different payloads as outlined in Table 21. As shown in FIG. 63, treatment with a combination of ONCR-152 and ONCR-140 enhanced the tumor growth inhibition in non-injected tumors, indicating that FLT3L expression can enhance the abscopal effect over that observed with IL-12, CXL10, and CCL4.

TABLE 20

| Combo | Payloads | Injected | | | Non-injected | | |
|---|---|---|---|---|---|---|---|
| | | CR | % TGI | p | CR | % TGI | p |
| ONCR-133 | IL-12 | 3/8 | 82 | <0.0001 | 0/8 | 44 | 0.19 |
| ONCR-151 | IL-12, CXCL10, XCL1 | 3/8 | 76 | <0.0001 | 0/8 | 33 | 0.35 |
| ONCR-152 | IL-12, CXCL10, FLT3L | 1/8 | 81 | <0.0001 | 0/8 | 34 | 0.3 |
| ONCR-153 | IL-12, CXCL10, CCL4 | 3/8 | 89 | <0.0001 | 0/8 | 58 | 0.001 |

TABLE 21

| Combo | Payloads | Injected | | | Non-injected | | |
|---|---|---|---|---|---|---|---|
| | | CR | % TGI | p | CR | % TGI | p |
| 152 + 140 | IL12, CXCL10, CCL4 | 8/8 | 97 | <0.0001 | 3/8 | 69 | 0.29 |
| 153 + 140 | IL 12, CXCL10, FLT3 | 8/8 | 99 | <0.0001 | 3/8 | 58 | 0.22 |
| 152 + 153 | IL 12, CXCL10, CCL4, FLT3 | 8/8 | 97 | <0.0001 | 3/8 | 75 | 0.005 |

Example 13—CD40L Expression Further Enhances Abscopal Efficacy of HSV

Experiments were performed to assess the effects of CD40L in tumor growth inhibition in the MC38 model described in Example F. Results of this experiment are shown in FIG. 64 and Table 22 below. Mice were treated with constructs expressing different payloads as outlined in Table 22. As shown in FIG. 64, treatment with a combination of ONCR-153 and ONCR-147 enhanced the tumor growth inhibition in non-injected tumors, indicating that CD40L expression can enhance the abscopal effect over that observed with IL-12, CXL10, and CCL4.

TABLE 22

| Combo | Payloads | Injected | | | Non-injected | | |
|---|---|---|---|---|---|---|---|
| | | CR | % TGI | p | CR | % TGI | p |
| 153 | IL12, CXCL10, CCL4 | 1/8 | 65 | 0.0005 | 0/8 | 41 | 0.02 |
| 147 | CD40L, 41BBL | 0/8 | 14 | 0.35 | 0/8 | — | 0.83 |
| 153 + 147 | IL12, CXCL10, CCL4, CD40L, 41BBL | 2/8 | 73 | <0.0001 | 0/8 | 59 | 0.0005 |

Example 12—Anti-CTLA4 Expression Further Enhances Abscopal Efficacy of HSV

Experiments were performed to assess the effects of CTLA4 in tumor growth inhibition in the MC38 model described in Example F. Results of this experiment are shown in FIG. 66A-FIG. 66C and Table 23 below. Mice were treated with constructs expressing different payloads as outlined in Table 23. As shown in FIG. 66A-FIG. 66C, treatment with a combination of ONCR-149 and ONCR-139 enhanced the tumor growth inhibition in injected and non-injected tumors compared to treatment with ONCR-149 alone, indicating that anti-CTLA4 expression can enhance the anti-tumor effects and abscopal effect over that observed with IL-12.

TABLE 23

| Combo | Payloads | Injected | | | Non-injected | | |
|---|---|---|---|---|---|---|---|
| | | CR | % TGI | p | CR | % TGI | p |
| 149 | IL 12 | 0/8 | 66 | <0.0001 | 0/8 | 41 | 0.0002 |
| 149 + 139 | IL 12, anti-CTLA4 | 1/8 | 75 | <0.0001 | 1/8 | 57 | <0.0001 |

Similar experiments were performed to assess the effects of anti-CTLA4 over IL-12, CXCL10, FLT3L, and CCL4 expression in a 4T1-luc model. In brief, 1×10⁶ 4T1-luc cells in 100 μL of DPBS were injected subcutaneously into the right flank of Balb/c mice. When tumor volume reach an average of 100 mm³, mice were intratumorally injected with HSV-1 at a dose of 3e⁶ PFU/injection. Dosing was repeated twice every third day for a total number of 3 doses (Q3D×3). Tumor growth and body weight was monitor twice weekly. The experiment concluded at Day 22 when the first clinical symptoms of metastatic disease were observed. Lung metastases were visualized ex vivo using IVIS Lumina LT system and analyzed with Living Image Software. Mice were treated with a combination of constructs as shown in Table 24. Results of this experiment are shown in FIG. 67. As shown, treatment with ONCR-152 and -139 demonstrated an enhanced effect in tumor growth inhibition compared to treatment with ONCR-139 alone.

TABLE 24

| Combo | Payloads |
|---|---|
| 152 | IL12, CXCL10, FLT3L |
| 139 | anti-CTLA4 |
| 152 + 139 | IL12, CXCL10, FLT3L, anti-CTLA4 |

Example 13—Treatment with Anti-PD1 Expression Further Enhances Efficacy of HSV

Experiments were performed to assess the effects of anti-PD1 treatment on HSV-mediated tumor growth inhibition in the MC38 model described in Example F. Results of this experiment are shown in FIG. 68 and Table 25 below. Mice were treated with constructs expressing different payloads as outlined in Table 25. As shown in FIG. 68, treatment with a combination of ONCR-153 and anti-PD1 enhanced the tumor growth inhibition in injected tumors compared to that observed with ONCR-152 or anti-PD1 alone.

TABLE 25

| | | Injected | | | Non-injected | | |
|---|---|---|---|---|---|---|---|
| Combo | Payloads | CR | % TGI | p | CR | % TGI | p |
| 153 | IL12, CXCL10, CCL4 | 2/8 | 79 | <0.0001 | 5/8 | 84 | <0.0001 |
| anti-PD1 | | 5/8 | 65 | 0.0005 | 0/8 | 41 | 0.02 |
| 153 + anti-PD1 | IL12, CXCL10, CCL4, anti-PD1 | 2/8 | 95 | <0.0001 | 0/8 | 83 | <0.0001 |

Example 14—Treatment of a Patient Suffering from Pancreatic Cancer, Lung Cancer, or Colon Cancer A patient suffering from pancreatic cancer, lung cancer, or colon cancer is treated using the compositions and methods disclosed herein. HSV-based viral stocks may be generated that are attenuated by incorporating one or more miRNA target sequences into UL19, ICP4, ICP27, or UL42 (or other viral genes) as shown in FIGS. 39-50. In some cases, genome-editing capabilities for tumor destruction and/or microenvironment remodeling are engineered into the virus in addition to miRNA target sequences, as shown in FIGS. 45-46. In a specific example, an HSV-based stock containing miR-124, miR-451a, miR-143-3p, and miR-559 attenuation cassettes incorporated into ICP4 and ICP27 is used. In another example, an HSV-based stock containing attenuation cassettes with one or more copies of miR-122 and miR-125a target sequences incorporated into ICP27 and/or UL42 genes. For any of these compositions, the HSV-based stock is generated according to the methods described in Example 3. The miRNA target sequence cassettes are introduced into the 3' UTR of the ICP4, ICP27UL19, and/or UL42 genes. BAC constructs are converted to virus particles with simultaneous removal of the BAC sequences located between loxP sites by transfection of Vero-Cre cells. Following plaque purification, virus stocks are further purified, buffer exchanged, and titered on Vero cells. For in vivo administration to a patient suffering from pancreatic cancer, lung cancer, or colon cancer, HSV particles are prepared in phosphate buffered solution (PBS) along with pharmaceutically acceptable stabilizing agents. On the day of treatment, $10^9$ vector genomes in a volume of 1.0 mL pharmaceutically acceptable carrier are administered via intra-tumoral infusion. The patient is monitored for tumor regression using standard of care procedures at an appropriate time interval based on that patient's particular prognosis.

Example 15—Treatment of Patients Suffering from Brain Cancer, Bladder Cancer, Breast Cancer, or Head and Neck Cancer A patient suffering from brain cancer, bladder cancer, breast cancer, or head and neck cancer is treated using the compositions and methods disclosed herein. An HSV-based viral stock is generated containing miR-124, miR-451a, miR-145-3p, and miR-559 attenuation cassettes according to the methods described in Example 3. The miRNA target sequence cassettes are introduced into the 3' UTR of the ICP4 (miR-124) and ICP27 (miR-451a, miR-145-3p, miR-559) genes as shown in FIG. 48. BAC constructs are converted to virus particles with simultaneous removal of the BAC sequences located between loxP sites by transfection of Vero-Cre cells. Following plaque purification, virus stocks are further purified, buffer exchanged, and titered on Vero cells. For in vivo administration to a patient suffering from brain cancer, bladder cancer, breast cancer, or head and neck cancer, HSV particles are prepared in phosphate buffered solution (PBS) along with pharmaceutically acceptable stabilizing agents. On the day of treatment, 109 vector genomes in a volume of 1.0 mL pharmaceutically acceptable carrier are administered via intra-tumoral infusion. The patient is monitored using standard of care procedures at an appropriate time interval based on that patient's particular prognosis. Potential outcomes of these experiments include partial or complete inhibition of tumor growth, inhibition of tumor metastasis, prolonged time in remission, and/or reduced rate of relapse compared to standard of care therapies.

Example 16—Treatment of a Patient Suffering from Schwannoma

A patient suffering from schwannoma is treated using the compositions and methods disclosed herein. An HSV-based viral stock is generated containing miR-124-3p, miR-205-5p, miR-141-5p, and miR-31-5p attenuation cassettes according to the methods described in Example 3. The miRNA target sequence cassettes were recombined into the 3' UTR of the ICP4 (miR-124) and ICP27 (miR-205-5p, miR-141-5p, miR-31-5p) genes as shown in FIG. 49. BAC constructs are converted to virus particles with simultaneous removal of the BAC sequences located between loxP sites by transfection of Vero-Cre cells. Following plaque purification, virus stocks were further purified, buffer exchanged, and titered on Vero cells. For in vivo administration to a patient suffering from schwannoma, HSV particles are prepared in phosphate buffered solution (PBS) along with pharmaceutically acceptable stabilizing agents. On the day of treatment, 109 vector genomes in a volume of 1.0 mL pharmaceutically acceptable carrier are administered via intra-tumoral infusion. The patient is monitored using standard of care procedures at an appropriate time interval based on that patient's particular prognosis. Potential outcomes of these experiments include partial or complete inhibition of tumor growth, inhibition of tumor metastasis, prolonged time in remission, and/or reduced rate of relapse compared to standard of care therapies While preferred embodiments of the present invention are shown and described herein, it will be obvious to those skilled in the art that such embodiments are provided by way of example only. Numerous variations, changes, and substitutions can be implemented by those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

INCORPORATION BY REFERENCE

All references, articles, publications, patents, patent publications, and patent applications cited herein are incorporated by reference in their entireties for all purposes. How-

TABLE 1

Summary of relationships between 12 select oncomiRs (9 tumor suppressors and 3 oncogenic miRNAs) and various cancers

| Malignancy | Down-regulated | | | | | | | | | Up-regulated | | |
|---|---|---|---|---|---|---|---|---|---|---|---|---|
| | let-7 | miR-15a | miR-16 | miR-29a | miR-34a | miR-98 | miR-101 | miR-124 | miR-202 | miR-17 | miR-21 | miR-155 |
| acute lymphoblastic leukemia | X | | | | | | | X | | X | | X |
| acute myeloid leukemia | X | | | X | | | | | | X | | X |
| acute promyelocytic leukemia | X | | | | | | | | | | | |
| adrenal cortical carcinoma | | | | | | | | | | | X | |
| anaplastic astrocytoma | | | | | | | | X | | | | |
| anaplastic large-cell lymphoma | | | | | | | | | | | | X |
| astrocytoma | | | | | | | | X | | | | |
| B cell lymphoma | | | | | X | | | | | X | | |
| bladder cancer | | | X | | X | | X | X | | X | | X |
| breast cancer | X | X | X | X | X | X | | X | | X | | X |
| breast carcinoma | | | | | | | | | | X | | |
| bronchioloalveolar carcinoma | X | | | | X | | | | | | | |
| cervical cancer | | | | | | | | X | | X | | X |
| cervical carcinoma | | X | X | | X | | X | | | | | |
| cervical squamous cell carcinoma | | | | X | | | | X | | | | |
| cholangiocarcinoma | | | | | X | | X | | | X | | |
| chondrosarcoma | X | | | | | | | | | | | |
| chordoma | | | | | X | | | | | | | |
| choriocarcinoma | | | | | X | | | | | | | |
| chronic lymphocytic leukemia | | X | X | | | | | | | | | X |
| chronic myelogenous leukemia | | | X | | | | | | | | | X |
| clear cell renal cell cancer | | | | | X | | | | | | | X |
| colon cancer | X | | | | X | X | X | | | | | X |
| colorectal cancer | X | X | X | X | X | | X | X | X | X | | X |
| colorectal carcinoma | | | | | | | | | | X | | X |
| cutaneous T cell lymphoma | | | | | | | | | | | | X |
| diffuse large B cell lymphoma | | | | | | | | | | | | X |
| endometrial cancer | | | | | X | | X | | | | | X |
| epithelial ovarian cancer | | | | | | | | X | | | | |
| esophageal cancer | | X | | | | | X | X | | | | |
| esophageal squamous cell carcinoma | X | | X | | X | X | X | | | X | | |
| extrahepatic cholangiocarcinoma | | | | | X | | | | | | | |
| follicular lymphoma | | | | | | | | | X | | | |
| gallbladder carcinoma | | | | | | | | | | | | X |
| gastric cancer | X | | | X | X | X | X | X | X | X | | X |
| glioblastoma | X | | | | X | | X | X | | | | |
| glioma | X | | X | | X | X | | X | | X | | X |
| head and neck cancer | | | | | | | | | | | | |
| head and neck squamous cell carcinoma | X | | X | X | X | | | | | | X | |
| hepatocellular carcinoma | X | | X | X | X | X | X | X | X | X | X | X |
| hypopharyngeal squamous cell carcinoma | | | | | | | | | | | X | |
| kidney cancer | | | | | | | | | | | | |
| laryngeal carcinoma | | | X | | | | | | | | X | |
| laryngeal squamous cell carcinoma | | | | | | | X | | | | X | |
| liver cancer | | | | | | | X | | | | X | X |
| lung adenocarcinoma | | | X | | | | | | | | | X |
| lung cancer | X | X | X | | X | X | X | | | X | X | X |
| malignant melanoma | X | | | | X | X | X | | | X | X | X |
| malt lymphoma | | | | | | | | | | | | X |
| mantle cell lymphoma | | | | X | | | | X | | X | | X |
| medulloblastoma | | | | | | | | X | | X | | |
| mesenchymal cancer | | | | X | | | | | | | | |
| monocytic leukemia | | | | X | | | | | | | | |
| multiple myeloma | | | | | | | | | | | X | |
| nasopharyngeal cancer | | | | | | | | | | X | | |
| nasopharyngeal carcinoma | X | | | | | X | X | X | | | X | X |
| neuroblastoma | X | X | X | X | X | X | | X | | | | |
| non-small cell lung cancer | X | X | X | X | X | | X | X | | X | X | X |
| oral cancer | X | | | | X | | | | | | X | |
| oral squamous cell carcinoma | | | | | X | | | X | | | X | X |

TABLE 1-continued

Summary of relationships between 12 select oncomiRs (9 tumor suppressors and 3 oncogenic miRNAs) and various cancers

| Malignancy | Down-regulated | | | | | | | | | Up-regulated | | |
|---|---|---|---|---|---|---|---|---|---|---|---|---|
| | let-7 | miR-15a | miR-16 | miR-29a | miR-34a | miR-98 | miR-101 | miR-124 | miR-202 | miR-17 | miR-21 | miR-155 |
| osteosarcoma | X | X | X | | X | | X | X | X | X | X | |
| ovarian cancer | X | | | | X | X | | X | | | X | X |
| ovarian carcinoma | | | | | | | X | | | | | |
| pancreatic adenocarcinoma | | | | | X | | | | | | X | |
| pancreatic cancer | | X | | | | | X | X | | X | X | |
| pancreatic ductal adenocarcinoma | X | X | X | | X | X | | | | | X | |
| papillary thyroid carcinoma | X | | X | | X | | X | | | | X | X |
| pituitary carcinoma | | | | | | | | | | X | | |
| prostate cancer | X | X | X | | X | | X | X | | | X | |
| rectal cancer | | | | | X | | | | | | X | X |
| renal cell carcinoma | X | | X | | X | | | | | | X | |
| renal clear cell carcinoma | X | | | | | | | | | | | X |
| retinoblastoma | | | | | X | X | | | | | X | |
| squamous carcinoma | | X | X | | X | | | | | | X | X |
| T cell lymphoblastic lymphoma | | | | | | | | | | X | | |
| uveal melanoma | | | | | X | | | | | | | |

TABLE 2

Summary of miRNA expression in cancer

| Malignancy | Down-regulated miRs | Up-regulated miRs |
|---|---|---|
| breast cancer | let-7a, let-7a-1, let-7a-2, let-7a-3, let-7b, let-7c, let-7d, let-7e, let-7f-1, let-7f-2, let-7g, let-7i, mir-100, mir-107, mir-10a, mir-10b, mir-122, mir-124, mir-1258, mir-125a-5p, mir-125b, mir-126, mir-127, mir-129, mir-130a, mir-132, mir-133a, mir-143, mir-145, mir-146a, mir-146b, mir-147, mir-148a, mir-149, mir-152, mir-153, mir-15a, mir-16, mir-17-5p, mir-181a, mir-1826, mir-183, mir-185, mir-191, mir-193a-3p, mir-193b, mir-195, mir-199b-5p, mir-19a-3p, mir-200a, mir-200b, mir-200c, mir-205, mir-206, mir-211, mir-216b, mir-218, mir-22, mir-26a, mir-26b, mir-300, mir-30a, mir-31, mir-335, mir-339-5p, mir-33b, mir-34a, mir-34b, mir-34c, mir-374a, mir-379, mir-381, mir-383, mir-425, mir-429, mir-450b-3p, mir-494, mir-495, mir-497, mir-502-5p, mir-517a, mir-574-3p, mir-638, mir-7, mir-720, mir-7515, mir-92a, mir-98, mir-99a, mmu-mir-290-3p, mmu-mir-290-5p | mir-10b, mir-125a, mir-135a, mir-140, mir-141, mir-142, mir-150, mir-155, mir-181a, mir-181b, mir-182, mir-18a, mir-18b, mir-191, mir-196a, mir-197, mir-19a, mir-19b, mir-200a, mir-200b, mir-200c, mir-203, mir-205, mir-20a, mir-20b, mir-21, mir-217, mir-221, mir-224, mir-23a, mir-24, mir-24-2-5p, mir-24-3p, mir-27a, mir-29a, mir-29b-1, mir-29b-2, mir-29c, mir-373, mir-378, mir-423, mir-429, mir-495, mir-503, mir-510, mir-520c, mir-526b, mir-96 |
| chondrosarcoma | let-7a, mir-100, mir-136, mir-145, mir-199a, mir-222, mir-30a, mir-335, mir-376a | |
| colorectal cancer | let-7a, mir-1, mir-100, mir-101, mir-124, mir-125a, mir-126, mir-129, mir-1295b-3p, mir-1307, mir-130b, mir-132, mir-133a, mir-133b, mir-137, mir-138, mir-139, mir-139-5p, mir-140-5p, mir-143, mir-145, mir-148a, mir-148b, mir-149, mir-150-5p, mir-154, mir-15a, mir-15b, mir-16, mir-18a, mir-191, mir-192, mir-193a-5p, mir-194, mir-195, mir-196a, mir-198, mir-199a-5p, mir-200c, mir-203, mir-204-5p, mir-206, mir-212, mir-215, mir-218, mir-22, mir-224, mir-24-3p, mir-26b, mir-27a, mir-28-3p, mir-28-5p, mir-29b, mir-30a-3p, mir-30b, mir-320a, mir-328, mir-338-3p, mir-342, mir-345, mir-34a, mir-34a-5p, mir-361-5p, mir-375, mir-378, mir-378a-3p, mir-378a-5p, mir-409-3p, mir-422a, mir-4487, mir-483, mir-497, mir-498, mir- | let-7a, mir-103, mir-106a, mir-10b, mir-1179, mir-1229, mir-1246, mir-125b-2*, mir-1269a, mir-130b, mir-133b, mir-135a, mir-135a-1, mir-135a-2, mir-135b, mir-139-3p, mir-145, mir-150, mir-150*, mir-155, mir-17, mir-181a, mir-182, mir-183, mir-18a, mir-191, mir-196a, mir-196b, mir-19a, mir-19b, mir-200b, mir-200c, mir-203, mir-204-5p, mir-20a, mir-20a-5p, mir-21, mir-210, mir-211, mir-221, mir-223, mir-224, mir-23a, mir-25, mir-27a, mir-29a, mir-301a, mir-31, mir-32, mir-320b, mir-326, mir-424, mir-429, mir-494, mir-497, mir-499-5p, mir-592, mir-630, mir-7-5p, mir- |

TABLE 2-continued

Summary of miRNA expression in cancer

| Malignancy | Down-regulated miRs | Up-regulated miRs |
| --- | --- | --- |
| | 518a-3p, mir-551a, mir-574-5p, mir-625, mir-638, mir-7, mir-96-5p | 892a, mir-92, mir-92a, mir-93, mir-95, mir-96 |
| esophageal squamous cell carcinoma | let-7a, let-7a-1, let-7a-2, let-7a-3, let-7b, let-7c, let-7d, let-7e, let-7f-1, let-7f-2, let-7g, let-7i, mir-1, mir-100, mir-101, mir-126, mir-1294, mir-133a, mir-133b, mir-138, mir-143, mir-145, mir-150, mir-185, mir-195, mir-200b, mir-203, mir-21, mir-210, mir-214, mir-218, mir-22, mir-27a, mir-29b, mir-29c, mir-302b, mir-34a, mir-375, mir-494, mir-518b, mir-655, mir-98, mir-99a | mir-100, mir-1179, mir-1290, mir-130b, mir-145, mir-16, mir-17, mir-183, mir-18a, mir-19a, mir-19b, mir-208, mir-20a, mir-21, mir-218, mir-223, mir-25, mir-30a-5p, mir-31, mir-330-3p, mir-373, mir-9, mir-92a, mir-942 |
| gastric cancer | let-7a, let-7b, let-7g, mir-1, mir-101, mir-103a, mir-10a, mir-10b, mir-1207-5p, mir-122, mir-1228*, mir-124, mir-124-3p, mir-125a-3p, mir-126, mir-1266, mir-1271, mir-129-1-3p, mir-129-2-3p, mir-129-3p, mir-129-5p, mir-133a, mir-133b, mir-137, mir-141, mir-143, mir-144, mir-145, mir-146a, mir-146a-5p, mir-148a, mir-148b, mir-149, mir-152, mir-155, mir-155-5p, mir-181a, mir-181b, mir-182, mir-183, mir-185, mir-194, mir-195, mir-197, mir-199a-3p, mir-200b, mir-200c, mir-202-3p, mir-204, mir-204-5p, mir-205, mir-206, mir-210, mir-212, mir-217, mir-218, mir-22, mir-23b, mir-24, mir-26a, mir-29a, mir-29a-3p, mir-29b, mir-29b-1, mir-29b-2, mir-29c, mir-30a-5p, mir-30b, mir-31, mir-328, mir-329, mir-331-3p, mir-335-5p, mir-338, mir-338-3p, mir-34a, mir-34b, mir-34c, mir-361-5p, mir-367, mir-375, mir-378, mir-409-3p, mir-410, mir-429, mir-433, mir-449, mir-449a, mir-490-3p, mir-494, mir-497, mir-503, mir-506, mir-513b, mir-520d-3p, mir-542-3p, mir-622, mir-625, mir-638, mir-663, mir-7, mir-765, mir-9 | mir-100, mir-103, mir-106a, mir-106b, mir-107, mir-10a, mir-10b, mir-1259, mir-125b, mir-126, mir-1274a, mir-1303, mir-130b*, mir-135a-5p, mir-135b, mir-138, mir-143, mir-146a, mir-147, mir-148a, mir-150, mir-17, mir-17-5p, mir-181a, mir-181a-2*, mir-181a-5p, mir-181c, mir-183, mir-185, mir-18a, mir-191, mir-192, mir-196a, mir-196a*, mir-196a-5p, mir-196b, mir-199a, mir-199a-3p, mir-199a-5p, mir-19a, mir-19b, mir-200b, mir-20a, mir-21, mir-214, mir-215, mir-221, mir-221*, mir-222, mir-223, mir-224, mir-23a, mir-23b, mir-27a, mir-27b, mir-296-5p, mir-301a, mir-302f, mir-337-3p, mir-340*, mir-34a, mir-362-3p, mir-370, mir-374a, mir-377, mir-421, mir-425, mir-500, mir-520c-3p, mir-544, mir-575, mir-601, mir-616*, mir-650, mir-92, mir-98, mir-99a |
| glioma | let-7a, let-7f, mir-106a, mir-107, mir-122, mir-124, mir-124-5p, mir-124a, mir-125b, mir-128, mir-136, mir-137, mir-139, mir-143, mir-145, mir-146a, mir-146b, mir-146b-5p, mir-152, mir-15b, mir-16, mir-181a, mir-181a-1, mir-181a-2, mir-181b, mir-181b-1, mir-181b-2, mir-181c, mir-181d, mir-184, mir-185, mir-195, mir-199a-3p, mir-200a, mir-200b, mir-203, mir-204, mir-205, mir-218, mir-219-5p, mir-23b, mir-26b, mir-27a, mir-29c, mir-320, mir-326, mir-328, mir-34a, mir-34c-3p, mir-34c-5p, mir-375, mir-383, mir-451, mir-452, mir-483-5p, mir-495, mir-584, mir-622, mir-656, mir-7, mir-98 | mir-106b, mir-106b-5p, mir-10b, mir-125b, mir-132, mir-155, mir-17, mir-181a, mir-182, mir-183, mir-193b, mir-19a, mir-19b, mir-20a, mir-210, mir-214, mir-221, mir-222, mir-224, mir-23a, mir-24, mir-24-3p, mir-25, mir-26a, mir-27a-3p, mir-27b, mir-30a-5p, mir-30e, mir-30e*, mir-328, mir-335, mir-33a, mir-372, mir-486, mir-494, mir-497, mir-566, mir-603, mir-650, mir-675, mir-9, mir-92b, mir-93, mir-96 |
| nasopharyngeal carcinoma | let-7a, let-7a-1, let-7a-2, let-7a-3, let-7b, let-7c, let-7d, let-7e, let-7f-1, let-7f-2, let-7g, let-7i, mir-1, mir-101, mir-124, mir-138, mir-143, mir-145, mir-148a, mir-200b, mir-204, mir-216b, mir-29c, mir-320a, mir-324-3p, mir-34c, mir-375, mir-378, mir-451, mir-506, mir-9, mir-98 | mir-10b, mir-144, mir-149, mir-155, mir-18a, mir-21, mir-214, mir-24, mir-421, mir-663, mir-7-5p, mir-93 |
| non-small cell lung cancer | let-7a, let-7c, mir-1, mir-100, mir-101, mir-106a, mir-107, mir-124, mir-125a-3p, mir-125a-5p, mir-126*, mir-129, mir-133a, mir-137, mir-138, mir-140, mir-143, mir-145, mir-146a, mir-146b, mir-148a, mir-148b, mir-149, mir-152, mir-153, mir-154, mir-155, mir-15a, mir-16, mir-17-5p, mir-181a-1, mir-181a-2, mir-181b, mir-181b-1, mir-181b-2, mir-181c, mir-181d, mir-184, mir-186, mir-193b, mir-195, mir-199a, mir-204, mir-212, mir-221, mir-224, mir-26b, mir-27a, mir-27b, mir-29a, mir-29b, mir-29c, mir-30a, mir-30b, mir-30c, mir-30d, mir-30d-5p, mir-30e-5p, mir-32, mir-335, mir-338- | mir-10b, mir-125a-5p, mir-1280, mir-136, mir-140, mir-141, mir-142-3p, mir-145, mir-146a, mir-150, mir-18a, mir-196a, mir-19a, mir-200a, mir-200c, mir-205, mir-205-5p, mir-21, mir-212, mir-22, mir-221, mir-222, mir-24, mir-25, mir-29c, mir-31, mir-328, mir-330-3p, mir-339, mir-34a, mir-375, mir-494, mir-675-5p, mir-9, mir-92b, mir-93, mir-95 |

TABLE 2-continued

Summary of miRNA expression in cancer

| Malignancy | Down-regulated miRs | Up-regulated miRs |
|---|---|---|
| | 3p, mir-340, mir-342-3p, mir-34a, mir-34b, mir-361-3p, mir-365, mir-373, mir-375, mir-429, mir-449a, mir-4500, mir-451, mir-4782-3p, mir-497, mir-503, mir-512-3p, mir-520a-3p, mir-526b, mir-625*, mir-96, mir-99a | |
| osteosarcoma | let-7a, mir-1, mir-100, mir-101, mir-122, mir-124, mir-125b, mir-126, mir-127-3p, mir-132, mir-133a, mir-141, mir-142-3p, mir-142-5p, mir-143, mir-144, mir-145, mir-153, mir-16, mir-183, mir-194, mir-195, mir-199a-3p, mir-204, mir-212, mir-217, mir-218, mir-22, mir-23a, mir-24, mir-26a, mir-26b, mir-29b, mir-32, mir-320, mir-335, mir-33b, mir-340, mir-34a, mir-34b, mir-34c, mir-375, mir-376c, mir-382, mir-3928, mir-424, mir-429, mir-449a, mir-451, mir-454, mir-503, mir-519d, mir-646 | mir-128, mir-151-3p, mir-17, mir-181a, mir-181b, mir-181c, mir-18a, mir-191, mir-195-5p, mir-199a-3p, mir-19a, mir-19b, mir-20a, mir-21, mir-210, mir-214, mir-221, mir-27a, mir-300, mir-320a, mir-374a-5p, mir-720, mir-9, mir-92a |
| pancreatic ductal adenocarcinoma | let-7a, let-7a-1, let-7a-2, let-7a-3, let-7b, let-7c, let-7d, let-7e, let-7f-1, let-7f-2, let-7g, let-7i, mir-126, mir-135a, mir-143, mir-144, mir-145, mir-148a, mir-150, mir-15a, mir-16, mir-200a, mir-200b, mir-200c, mir-217, mir-218, mir-337, mir-375, mir-494, mir-615-5p, mir-98 | mir-10b, mir-186, mir-18a, mir-192, mir-194, mir-196a, mir-198, mir-203, mir-21, mir-212, mir-30b-5p, mir-31, mir-34a, mir-369-5p, mir-376a, mir-541 |
| renal cell carcinoma | let-7a, let-7d, mir-1, mir-106a*, mir-126, mir-1285, mir-129-3p, mir-1291, mir-133a, mir-133b, mir-135a, mir-138, mir-141, mir-143, mir-145, mir-182-5p, mir-199a-3p, mir-200a, mir-205, mir-218, mir-28-5p, mir-30a, mir-30c, mir-30d, mir-34a, mir-378, mir-429, mir-509-3p, mir-509-5p, mir-646 | mir-100, mir-1233, mir-1260b, mir-146a, mir-146b, mir-16, mir-193a-3p, mir-203b, mir-21, mir-210, mir-27a, mir-362, mir-572, mir-7 |
| bronchioloalveolar carcinoma | let-7a-1, let-7a-2, let-7a-3, let-7b, let-7c, let-7d, let-7e, let-7f-1, let-7f-2, let-7g, let-7i, mir-98 | |
| colon cancer | let-7a-1, let-7a-2, let-7a-3, let-7b, let-7c, let-7d, let-7e, let-7f-1, let-7f-2, let-7g, let-7i, mir-100, mir-101, mir-126, mir-142-3p, mir-143, mir-145, mir-192, mir-200c, mir-21, mir-214, mir-215, mir-25, mir-302a, mir-320, mir-320a, mir-34a, mir-34c, mir-365, mir-373, mir-424, mir-429, mir-455, mir-484, mir-502, mir-503, mir-93, mir-98 | mir-1290, mir-145, mir-155, mir-181a, mir-18a, mir-200c, mir-31, mir-675 |
| hepatocellular carcinoma | let-7a-1, let-7a-2, let-7a-3, let-7b, let-7c, let-7d, let-7e, let-7f, let-7f-1, let-7f-2, let-7g, let-7i, mir-1, mir-100, mir-101, mir-105, mir-122, mir-122a, mir-1236, mir-124, mir-125b, mir-126, mir-127, mir-1271, mir-128-3p, mir-129-5p, mir-130a, mir-130b, mir-133a, mir-134, mir-137, mir-138, mir-139, mir-139-5p, mir-140-5p, mir-141, mir-142-3p, mir-143, mir-144, mir-145, mir-146a, mir-148a, mir-148b, mir-150-5p, mir-15b, mir-16, mir-181a-5p, mir-185, mir-188-5p, mir-193b, mir-195, mir-195-5p, mir-197, mir-198, mir-199a, mir-199a-5p, mir-199b, mir-199b-5p, mir-200a, mir-200b, mir-200c, mir-202, mir-203, mir-204-3p, mir-205, mir-206, mir-20a, mir-21, mir-21-3p, mir-211, mir-212, mir-214, mir-217, mir-218, mir-219-5p, mir-22, mir-26a, mir-26b, mir-29a, mir-29b-1, mir-29b-2, mir-29c, mir-302b, mir-302c, mir-30a, mir-30a-3p, mir-335, mir-338-3p, mir-33a, mir-34a, mir-34b, mir-365, mir-370, mir-372, mir-375, mir-376a, mir-377, mir-422a, mir-424, mir-424-5p, mir-433, mir-4458, mir-448, mir-450a, mir-451, mir-485-5p, mir-486-5p, mir-497, mir-503, mir-506, mir-519d, mir-520a, mir-520b, mir-520c-3p, mir-582-5p, mir-590-5p, | mir-106b, mir-10b, mir-122, mir-1228, mir-1269, mir-128a, mir-130a, mir-130b, mir-146a, mir-153, mir-155, mir-17-5p, mir-181a, mir-181a-1, mir-181a-2, mir-181b, mir-181b-1, mir-181b-2, mir-181c, mir-181d, mir-182, mir-183, mir-184, mir-190b, mir-191, mir-20a, mir-20b, mir-21, mir-210, mir-214, mir-215, mir-216a, mir-217, mir-221, mir-222, mir-223, mir-224, mir-23a, mir-24, mir-25, mir-27a, mir-301a, mir-30d, mir-31, mir-3127, mir-32, mir-331-3p, mir-362-3p, mir-371-5p, mir-372, mir-373, mir-423, mir-429, mir-452, mir-483-3p, mir-483-5p, mir-485-3p, mir-490-3p, mir-494, mir-495, mir-500, mir-501-5p, mir-519d, mir-520g, mir-574-3p, mir-590-5p, mir-630, mir-650, mir-657, mir-664, mir-885-5p, mir-9, mir-92a, mir-96 |

TABLE 2-continued

Summary of miRNA expression in cancer

| Malignancy | Down-regulated miRs | Up-regulated miRs |
|---|---|---|
| | mir-610, mir-612, mir-625, mir-637, mir-675, mir-7, mir-877, mir-940, mir-941, mir-98, mir-99a | |
| lung cancer | let-7a-1, let-7a-2, let-7a-3, let-7b, let-7c, let-7d, let-7e, let-7f-1, let-7f-2, let-7g, let-7i, mir-1, mir-101, mir-133b, mir-138, mir-142-5p, mir-144, mir-145, mir-1469, mir-146a, mir-153, mir-15a, mir-15b, mir-16-1, mir-16-2, mir-182, mir-192, mir-193a-3p, mir-194, mir-195, mir-198, mir-203, mir-217, mir-218, mir-22, mir-223, mir-26a, mir-26b, mir-29c, mir-33a, mir-34a, mir-34b, mir-34c, mir-365, mir-449a, mir-449b, mir-486-5p, mir-545, mir-610, mir-614, mir-630, mir-660, mir-7-5p, mir-9500, mir-98, mir-99b | mir-10b, mir-135b, mir-150, mir-155, mir-17, mir-182, mir-183-3p, mir-18a, mir-197, mir-19a, mir-19b, mir-205, mir-20a, mir-21, mir-210, mir-24, mir-30d, mir-4423, mir-5100, mir-570, mir-663, mir-7, mir-92a |
| neuroblastoma | let-7a-1, let-7a-2, let-7a-3, let-7b, let-7c, let-7d, let-7e, let-7f-1, let-7f-2, let-7g, let-7i, mir-124, mir-137, mir-145, mir-181c, mir-184, mir-200a, mir-29a, mir-335, mir-338-3p, mir-34a, mir-449a, mir-885-5p, mir-98 | mir-125b, mir-15a, mir-15b, mir-16-1, mir-16-2, mir-18a, mir-195, mir-19a, mir-23a, mir-421, mir-92 |
| prostate cancer | let-7a-3p, let-7c, mir-100, mir-101, mir-105, mir-124, mir-128, mir-1296, mir-130b, mir-133a-1, mir-133a-2, mir-133b, mir-135a, mir-143, mir-145, mir-146a, mir-154, mir-15a, mir-187, mir-188-5p, mir-199b, mir-200b, mir-203, mir-205, mir-212, mir-218, mir-221, mir-224, mir-23a, mir-23b, mir-25, mir-26a, mir-26b, mir-29b, mir-302a, mir-30a, mir-30b, mir-30c-1, mir-30c-2, mir-30d, mir-30e, mir-31, mir-330, mir-331-3p, mir-34a, mir-34b, mir-34c, mir-374b, mir-449a, mir-4723-5p, mir-497, mir-628-5p, mir-642a-5p, mir-720, mir-940 | mir-125b, mir-141, mir-153, mir-155, mir-181a-1, mir-181a-2, mir-181b, mir-181b-1, mir-181b-2, mir-181c, mir-181d, mir-182, mir-182-5p, mir-183, mir-18a, mir-204, mir-20a, mir-21, mir-221, mir-223-3p, mir-31, mir-429, mir-96 |
| acute lymphoblastic leukemia | let-7b, mir-124a, mir-142-3p | mir-128 |
| malignant melanoma | let-7b, mir-101, mir-125b, mir-1280, mir-143, mir-146a, mir-146b, mir-155, mir-17, mir-184, mir-185, mir-18b, mir-193b, mir-200c, mir-203, mir-204, mir-205, mir-206, mir-20a, mir-211, mir-218, mir-26a, mir-31, mir-33a, mir-34a, mir-34c, mir-376a, mir-376c, mir-573, mir-7, mir-9, mir-98 | mir-126, mir-141, mir-15b, mir-17, mir-17-5p, mir-182, mir-18a, mir-193b, mir-200a, mir-200b, mir-200c, mir-20a, mir-21, mir-210, mir-214, mir-221, mir-222, mir-429, mir-455-5p, mir-532-5p, mir-638, mir-92a |
| renal clear cell carcinoma | let-7b, let-7c, mir-138, mir-141, mir-200c, mir-204, mir-218, mir-335, mir-377, mir-506 | mir-122, mir-155, mir-630 |
| acute myeloid leukemia | let-7c, mir-17, mir-181a, mir-20a, mir-223, mir-26a, mir-29a, mir-30c, mir-7 | mir-125b, mir-126-5p, mir-128, mir-155, mir-29a, mir-32, mir-331, mir-370, mir-378 |
| acute promyelocytic leukemia | let-7c, mir-107, mir-342 | mir-181a, mir-181b, mir-92a |
| head and neck squamous cell carcinoma | let-7d, mir-1, mir-107, mir-128, mir-133a, mir-138, mir-149, mir-200c, mir-205, mir-218, mir-27a*, mir-29a, mir-29b-1, mir-29b-2, mir-29c, mir-300, mir-34a, mir-363, mir-375, mir-874 | mir-106b, mir-134, mir-16, mir-184, mir-196a, mir-21, mir-25, mir-30a-5p, mir-31, mir-372, mir-93 |
| oral cancer | let-7d, mir-218, mir-34a, mir-375, mir-494 | mir-10b, mir-196a-1, mir-196a-2, mir-196b, mir-21 |
| papillary thyroid carcinoma | mir-101, mir-130b, mir-138, mir-146a, mir-16, mir-195, mir-199a-3p, mir-204-5p, mir-219-5p, mir-26a, mir-34b, mir-613 | let-7e, mir-146b, mir-146b-5p, mir-151-5p, mir-155, mir-181a-1, mir-181a-2, mir-181b-1, mir-181b-2, mir-181c, mir-181d, mir-182, mir-183, mir-199b-5p, mir-21, mir-221, mir-222, mir-339-5p, mir-34a |
| glioblastoma | let-7g-5p, mir-100, mir-101, mir-106a, mir-124, mir-124a, mir-125a, mir-125a-5p, mir-125b, mir-127-3p, mir-128, mir-129, mir-136, mir-137, mir-139-5p, mir-142-3p, mir-143, mir-145, mir-146b-5p, mir-149, mir-152, mir-153, mir-195, mir-21, mir-212-3p, mir-219-5p, mir-222, mir-29b, mir-31, mir-3189-3p, mir-320, | mir-10b, mir-125b, mir-127-3p, mir-148a, mir-18a, mir-196a, mir-196a-1, mir-196a-2, mir-196b, mir-21, mir-210, mir-210-3p, mir-223, mir-340, mir-576-5p, mir-626, mir-92b |

TABLE 2-continued

Summary of miRNA expression in cancer

| Malignancy | Down-regulated miRs | Up-regulated miRs |
|---|---|---|
| | mir-320a, mir-326, mir-330, mir-331-3p, mir-340, mir-342, mir-34a, mir-376a, mir-449a, mir-483-5p, mir-503, mir-577, mir-663, mir-7, mir-744 | |
| ovarian cancer | let-7i, mir-100, mir-124, mir-125b, mir-129-5p, mir-130b, mir-133a, mir-137, mir-138, mir-141, mir-145, mir-148a, mir-152, mir-153, mir-155, mir-199a, mir-200a, mir-200b, mir-200c, mir-212, mir-335, mir-34a, mir-34b, mir-34c, mir-409-3p, mir-411, mir-429, mir-432, mir-449a, mir-494, mir-497, mir-498, mir-519d, mir-655, mir-9, mir-98 | mir-106a, mir-141, mir-148b, mir-181b, mir-182, mir-200a, mir-200c, mir-205, mir-20a, mir-21, mir-210, mir-214, mir-221, mir-224-5p, mir-23b, mir-25, mir-26a, mir-27a, mir-27b, mir-346, mir-378, mir-424, mir-503, mir-572, mir-9, mir-96 |
| bladder cancer | mir-1, mir-101, mir-1180, mir-1236, mir-124-3p, mir-125b, mir-126, mir-1280, mir-133a, mir-133b, mir-141, mir-143, mir-144, mir-145, mir-155, mir-16, mir-18a, mir-192, mir-195, mir-200a, mir-200b, mir-200c, mir-203, mir-205, mir-214, mir-218, mir-23b, mir-26a, mir-29c, mir-320c, mir-34a, mir-370, mir-409-3p, mir-429, mir-451, mir-490-5p, mir-493, mir-576-3p, mir-99a | mir-103a-3p, mir-10b, mir-135a, mir-137, mir-141, mir-155, mir-17-5p, mir-182, mir-182-5p, mir-183, mir-185, mir-19a, mir-203, mir-205, mir-210, mir-221, mir-222, mir-223, mir-23a, mir-23b, mir-26b, mir-639, mir-96 |
| chordoma | mir-1, mir-222, mir-31, mir-34a, mir-608 | mir-140-3p, mir-148a |
| kidney cancer | mir-1, mir-145, mir-1826, mir-199a, mir-199a-3p, mir-203, mir-205, mir-497, mir-508-3p, mir-509-3p | mir-183, mir-21, mir-210, mir-223 |
| cervical carcinoma | mir-100, mir-101, mir-15a, mir-16, mir-34a, mir-886-5p, mir-99a, mir-99b | mir-133b, mir-21, mir-25, mir-373 |
| mesenchymal cancer | mir-100, mir-141, mir-199b-5p, mir-200a, mir-200b, mir-200c, mir-29a, mir-29b-1, mir-29b-1-5p, mir-29b-2, mir-29c, mir-335, mir-429, mir-99a | mir-125b-1-3p, mir-182 |
| oral squamous cell carcinoma | mir-100, mir-124, mir-1250, mir-125b, mir-126, mir-1271, mir-136, mir-138, mir-145, mir-147, mir-148a, mir-181a, mir-206, mir-220a, mir-26a, mir-26b, mir-29a, mir-32, mir-323-5p, mir-329, mir-338, mir-370, mir-410, mir-429, mir-433, mir-499a-5p, mir-503, mir-506, mir-632, mir-646, mir-668, mir-877, mir-9 | mir-125b, mir-126, mir-146a, mir-146b, mir-155, mir-181b, mir-196a-1, mir-196a-2, mir-196b, mir-21, mir-221, mir-222, mir-24, mir-27b, mir-31, mir-345 |
| ovarian carcinoma | mir-100, mir-101, mir-34b, mir-34c, mir-532-5p | mir-148b, mir-182 |
| cholangiocarcinoma | mir-101, mir-144, mir-200b, mir-200c | mir-17, mir-18a, mir-19a, mir-19b, mir-20a, mir-21, mir-26a, mir-92a |
| endometrial cancer | mir-101, mir-130a, mir-130b, mir-134, mir-143, mir-145, mir-152, mir-205, mir-223, mir-301a, mir-301b, mir-30c, mir-34a, mir-34c, mir-424, mir-449a, mir-543 | mir-106a, mir-145, mir-155, mir-182, mir-200b, mir-200c, mir-205, mir-21, mir-222-3p, mir-25, mir-93 |
| esophageal cancer | mir-124, mir-126, mir-140, mir-197, mir-203, mir-218, mir-223, mir-30b, mir-375, mir-454, mir-486, mir-574-3p | mir-101, mir-10b, mir-130a, mir-141, mir-143, mir-146b, mir-15a, mir-183, mir-196b, mir-200a, mir-203, mir-205, mir-21, mir-210, mir-221, mir-27a, mir-28-3p, mir-31, mir-452, mir-96, mir-99b |
| liver cancer | mir-101, mir-122, mir-132, mir-140-5p, mir-145, mir-148b, mir-31, mir-338-3p, mir-433 | mir-1301, mir-155, mir-21, mir-221, mir-27a, mir-525-3p |
| pancreatic cancer | mir-101, mir-1181, mir-124, mir-1247, mir-133a, mir-141, mir-145, mir-146a, mir-148a, mir-148b, mir-150*, mir-150-5p, mir-152, mir-15a, mir-198, mir-203, mir-214, mir-216a, mir-29c, mir-335, mir-34a, mir-34b, mir-34c, mir-373, mir-375, mir-410, mir-497, mir-615-5p, mir-630, mir-96 | mir-10a, mir-10b, mir-132, mir-15a, mir-17-5p, mir-181a, mir-18a, mir-191, mir-196a, mir-21, mir-212, mir-214, mir-222, mir-27a, mir-301a, mir-301a-3p, mir-367, mir-424-5p, mir-7, mir-92, mir-99a |
| retinoblastoma | mir-101, mir-183, mir-204, mir-34a, mir-365b-3p, mir-486-3p, mir-532-5p | mir-181b, mir-21 |
| cervical squamous cell carcinoma | mir-106a, mir-124, mir-148a, mir-214, mir-218, mir-29a, mir-375 | mir-205 |
| clear cell renal cell cancer | mir-106a-5p, mir-135a-5p, mir-206 | mir-142-5p, mir-155, mir-21-5p |

TABLE 2-continued

Summary of miRNA expression in cancer

| Malignancy | Down-regulated miRs | Up-regulated miRs |
| --- | --- | --- |
| laryngeal carcinoma | | mir-106b, mir-16, mir-21, mir-27a, mir-423-3p |
| medulloblastoma | mir-124, mir-128a, mir-199b-5p, mir-206, mir-22, mir-31, mir-383 | mir-106b, mir-17, mir-18a, mir-19a, mir-19b, mir-20a, mir-30b, mir-30d, mir-92 |
| pituitary carcinoma | | mir-106b, mir-122, mir-20a, mir-493 |
| prostate carcinoma | mir-107 | |
| cervical cancer | mir-143, mir-145, mir-17-5p, mir-203, mir-214, mir-218, mir-335, mir-342-3p, mir-372, mir-424, mir-491-5p, mir-497, mir-7, mir-99a, mir-99b | mir-10a, mir-155, mir-181a, mir-181b, mir-196a, mir-19a, mir-19b, mir-205, mir-20a, mir-21, mir-215, mir-224, mir-31, mir-494, mir-590-5p, mir-92a, mir-944 |
| chronic myelogenous leukemia | mir-10a, mir-146a, mir-150, mir-151, mir-155, mir-2278, mir-26a, mir-30e, mir-31, mir-326, mir-564 | mir-424, mir-96 |
| gastrointestinal cancer | mir-122a, mir-148a, mir-152 | |
| anaplastic astrocytoma | mir-124, mir-137 | |
| astrocytoma | mir-124-3p, mir-181b-5p, mir-200b, mir-3189-3p | mir-335 |
| epithelial ovarian cancer | mir-124a, mir-192, mir-193a, mir-7 | mir-372, mir-373 |
| mantle cell lymphoma | mir-142-3p, mir-142-5p, mir-150, mir-223, mir-29a, mir-29b, mir-29c | mir-124a, mir-155, mir-17, mir-18a, mir-19a, mir-19b, mir-20a, mir-92a |
| chronic lymphocytic leukemia | mir-125b, mir-138, mir-15a, mir-15b, mir-16, mir-16-1, mir-16-1-3p, mir-16-2, mir-181a, mir-181b, mir-195, mir-223, mir-29b, mir-34b, mir-34c, mir-424 | mir-150, mir-155 |
| follicular cancer | NA | mir-125b |
| malignant mesothelioma | mir-126 | |
| small cell lung cancer | mir-126, mir-138, mir-27a | mir-25 |
| meningioma | mir-128, mir-200a | mir-224, mir-335 |
| laryngeal squamous cell carcinoma | mir-129-5p, mir-203, mir-205, mir-206, mir-24, mir-370, mir-375 | mir-21, mir-9, mir-93 |
| medullary thyroid carcinoma | mir-129-5p | mir-183 |
| lung adenocarcinoma | mir-1297, mir-141, mir-145, mir-16, mir-200a, mir-200b, mir-200c, mir-29b, mir-381, mir-409-3p, mir-429, mir-451, mir-511, mir-99a | mir-150, mir-155, mir-31 |
| pancreatic carcinoma | mir-132, mir-375 | mir-301b |
| lung squamous cell carcinoma | mir-133a, mir-218 | |
| multiple myeloma | mir-137, mir-197, mir-214 | mir-21 |
| squamous carcinoma | mir-15a, mir-16, mir-203, mir-205, mir-375 | mir-137, mir-155, mir-184, mir-196a, mir-203, mir-21, mir-221, mir-27a, mir-34a |
| uveal melanoma | mir-137, mir-144, mir-145, mir-182, mir-34a, mir-34b, mir-34c, mir-9 | NA |
| anaplastic thyroid carcinoma | mir-138 | mir-146b, mir-221, mir-222 |
| colorectal carcinoma | mir-139, mir-143, mir-145, mir-202-3p, mir-30a, mir-338-3p, mir-429, mir-451, mir-93 | mir-17, mir-182, mir-191, mir-21, mir-95 |
| malt lymphoma | | mir-142-5p, mir-155 |
| thyroid cancer | mir-144, mir-886-3p | |
| primary cns lymphomas | mir-145, mir-193b, mir-199a, mir-214 | |
| follicular thyroid carcinoma | mir-199b | mir-146b, mir-183, mir-197, mir-221, mir-346 |
| gallbladder carcinoma | mir-146b-5p | mir-155, mir-182 |
| adult t-cell leukemia | | mir-150 |
| anaplastic large-cell lymphoma | | mir-155 |
| cutaneous t-cell lymphoma | | mir-155 |
| diffuse large B-cell lymphoma | | mir-155, mir-21 |
| rectal cancer | | mir-155, mir-200c, mir-21-5p, mir-34a |
| tongue cancer | mir-15b, mir-200b | |
| b-cell lymphoma | mir-34a | mir-17, mir-18a, mir-19a, mir-19b, mir-20a, mir-92a |

TABLE 2-continued

Summary of miRNA expression in cancer

| Malignancy | Down-regulated miRs | Up-regulated miRs |
|---|---|---|
| breast carcinoma | | mir-17, mir-18a, mir-19a, mir-19b, mir-20a, mir-24, mir-92a |
| nasopharyngeal cancer | mir-218, mir-223, mir-29c | mir-17, mir-20a |
| gastric adenocarcinoma | mir-181b, mir-182, mir-200a, mir-302b, mir-449a, mir-9 | mir-23a, mir-27a, mir-373 |
| colorectal adenocarcinoma | | mir-182 |
| colon carcinoma | mir-186, mir-30a-5p | mir-221, mir-23a |
| adrenal cortical carcinoma | mir-195, mir-1974, mir-335, mir-497 | mir-21, mir-210, mir-483-3p, mir-483-5p |
| esophageal adenocarcinoma | mir-203 | mir-196a, mir-199a-3p, mir-199a-5p, mir-199b-3p, mir-200a, mir-223 |
| gastrointestinal stromal tumor | mir-218, mir-221, mir-222 | mir-196a |
| uterine leiomyoma | mir-197 | |
| choriocarcinoma | mir-199b, mir-218, mir-34a | |
| follicular lymphoma | mir-202 | |
| basal cell carcinoma | mir-203 | |
| hypopharyngeal cancer | | mir-203 |
| pancreatic adenocarcinoma | | mir-203, mir-301a |
| rhabdomyosarcoma | mir-203 | |
| head and neck cancer | NA | mir-21 |
| hypopharyngeal squamous cell carcinoma | mir-451a, mir-504 | mir-21 |
| t-cell lymphoma | mir-22 | |
| thyroid carcinoma | | mir-221, mir-222 |
| splenic marginal zone lymphoma | mir-223 | |
| laryngeal cancer | | mir-23a |
| primary thyroid lymphoma | mir-26a | |
| acute leukemia | mir-27a | |
| monocytic leukemia | mir-29a, mir-29b | |
| oral carcinoma | mir-375 | mir-31 |
| primary gallbladder carcinoma | mir-335 | |
| endometrial serous adenocarcinoma | mir-34b | |
| esophageal carcinoma | mir-451 | |
| hepatoblastoma | | mir-492 |
| colonic adenocarcinoma | mir-627 | |

TABLE 4

Exemplary oncogenic miRs

| Cancer | miRNA |
|---|---|
| colorectal cancer | let-7a, mir-103, mir-106a, mir-10b, mir-1179, mir-1229, mir-1246, mir-125b-2*, mir-1269a, mir-130b, mir-133b, mir-135a, mir-135a-1, mir-135a-2, mir-135b, mir-139-3p, mir-145, mir-150, mir-150*, mir-155, mir-17, mir-181a, mir-182, mir-183, mir-18a, mir-191, mir-196a, mir-196b, mir-19a, mir-19b, mir-200b, mir-200c, mir-203, mir-204-5p, mir-20a, mir-20a-5p, mir-21, mir-210, mir-211, mir-221, mir-223, mir-224, mir-23a, mir-25, mir-27a, mir-29a, mir-301a, mir-31, mir-32, mir-320b, mir-326, mir-424, mir-429, mir-494, mir-497, mir-499-5p, mir-592, mir-630, mir-720, mir-892a, mir-92, mir-92a, mir-93, mir-95, mir-96 |
| papillary thyroid carcinoma | let-7e, mir-146b, mir-146b-5p, mir-151-5p, mir-155, mir-181a-1, mir-181a-2, mir-181b-1, mir-181b-2, mir-181c, mir-181d, mir-182, mir-183, mir-199b-5p, mir-21, mir-221, mir-222, mir-339-5p, mir-34a |
| esophageal squamous cell carcinoma | mir-100, mir-1179, mir-1290, mir-130b, mir-145, mir-16, mir-17, mir-183, mir-18a, mir-19a, mir-19b, mir-208, mir-20a, mir-21, mir-218, mir-223, mir-25, mir-30a-5p, mir-31, mir-330-3p, mir-373, mir-9, mir-92a, mir-942 |
| gastric cancer | mir-100, mir-103, mir-106a, mir-106b, mir-107, mir-10a, mir-10b, mir-1259, mir-125b, mir-126, mir-1274a, mir-1303, mir-130b*, mir-135a-5p, mir-135b, mir-138, mir-143, mir-146a, mir-147, mir-148a, mir-150, mir-17, mir-17-5p, mir-181a, mir-181a-2*, mir-181a-5p, mir-181c, mir-183, mir-185, mir-18a, mir-191, mir-192, mir-196a, mir-196a*, mir-196a-5p, mir-196b, mir-199a, mir-199a-3p, mir-199a-5p, mir-19a, mir-19b, mir-200b, mir-20a, mir-21, mir-214, mir-215, mir-221, mir-221*, mir- |

TABLE 4-continued

Exemplary oncogenic miRs

| Cancer | miRNA |
|---|---|
| | 222, mir-223, mir-224, mir-23a, mir-23b, mir-25, mir-27a, mir-27b, mir-296-5p, mir-301a, mir-302f, mir-337-3p, mir-340*, mir-34a, mir-362-3p, mir-370, mir-374a, mir-377, mir-421, mir-425, mir-500, mir-520c-3p, mir-544, mir-575, mir-601, mir-616*, mir-650, mir-92, mir-98, mir-99a |
| renal cell carcinoma | mir-100, mir-1233, mir-1260b, mir-146a, mir-146b, mir-16, mir-193a-3p, mir-203a, mir-21, mir-210, mir-27a, mir-362, mir-572, mir-7 |
| esophageal cancer | mir-101, mir-10b, mir-130a, mir-141, mir-143, mir-146b, mir-15a, mir-183, mir-196b, mir-200a, mir-203, mir-205, mir-21, mir-210, mir-221, mir-27a, mir-28-3p, mir-31, mir-452, mir-96, mir-99b |
| bladder cancer | mir-103a-3p, mir-10b, mir-135a, mir-137, mir-141, mir-155, mir-17-5p, mir-182, mir-182-5p, mir-183, mir-185, mir-19a, mir-203, mir-205, mir-210, mir-221, mir-222, mir-223, mir-23a, mir-23b, mir-26b, mir-639, mir-96 |
| endometrial cancer | mir-106a, mir-145, mir-155, mir-182, mir-200b, mir-200c, mir-205, mir-21, mir-222-3p, mir-25, mir-93 |
| ovarian cancer | mir-106a, mir-141, mir-148b, mir-181b, mir-182, mir-200a, mir-200c, mir-205, mir-20a, mir-21, mir-210, mir-214, mir-221, mir-224-5p, mir-23b, mir-25, mir-26a, mir-27a, mir-27b, mir-346, mir-378, mir-424, mir-503, mir-572, mir-9, mir-96 |
| glioma | mir-106b, mir-106b-5p, mir-10b, mir-125b, mir-132, mir-155, mir-17, mir-181a, mir-182, mir-183, mir-193b, mir-19a, mir-19b, mir-20a, mir-210, mir-214, mir-221, mir-222, mir-23a, mir-24, mir-24-3p, mir-25, mir-26a, mir-27a-3p, mir-27b, mir-30a-5p, mir-30e, mir-30e*, mir-328, mir-335, mir-33a, mir-372, mir-486, mir-494, mir-497, mir-566, mir-603, mir-650, mir-675, mir-9, mir-92b, mir-93, mir-96 |
| head and neck squamous cell carcinoma | mir-106b, mir-134, mir-16, mir-184, mir-196a, mir-21, mir-25, mir-30a-5p, mir-31, mir-372, mir-93 |
| hepatocellular carcinoma | mir-106b, mir-10b, mir-122, mir-1228, mir-1269, mir-128a, mir-130a, mir-130b, mir-146a, mir-153, mir-155, mir-17-5p, mir-181a, mir-181a-1, mir-181a-2, mir-181b, mir-181b-1, mir-181b-2, mir-181c, mir-181d, mir-182, mir-183, mir-184, mir-190b, mir-191, mir-20a, mir-20b, mir-21, mir-210, mir-214, mir-215, mir-216a, mir-217, mir-221, mir-222, mir-223, mir-224, mir-23a, mir-24, mir-25, mir-27a, mir-301a, mir-30d, mir-31, mir-3127, mir-32, mir-331-3p, mir-362-3p, mir-362-5p, mir-371-5p, mir-372, mir-373, mir-423, mir-429, mir-452, mir-483-3p, mir-483-5p, mir-485-3p, mir-490-3p, mir-494, mir-495, mir-500, mir-501, mir-501-5p, mir-519d, mir-520g, mir-574-3p, mir-590-5p, mir-630, mir-650, mir-657, mir-664, mir-885-5p, mir-9, mir-92a, mir-96 |
| laryngeal carcinoma | mir-106b, mir-16, mir-21, mir-27a, mir-423-3p |
| medulloblastoma | mir-106b, mir-17, mir-18a, mir-19a, mir-19b, mir-20a, mir-30b, mir-30d, mir-92 |
| pituitary carcinoma | mir-106b, mir-122, mir-17-5p, mir-20a, mir-493 |
| cervical cancer | mir-10a, mir-155, mir-181a, mir-181b, mir-196a, mir-19a, mir-19b, mir-205, mir-20a, mir-21, mir-215, mir-224, mir-31, mir-494, mir-590-5p, mir-92a, mir-944 |
| pancreatic cancer | mir-10a, mir-10b, mir-132, mir-15a, mir-17-5p, mir-181a, mir-18a, mir-191, mir-196a, mir-21, mir-212, mir-214, mir-221, mir-222, mir-27a, mir-301a, mir-301a-3p, mir-367, mir-424-5p, mir-7, mir-92, mir-99a |
| breast cancer | mir-10b, mir-125a, mir-135a, mir-140, mir-141, mir-142, mir-150, mir-155, mir-17, mir-17-5p, mir-181a, mir-181b, mir-182, mir-18a, mir-18b, mir-191, mir-196a, mir-197, mir-19a, mir-19b, mir-200a, mir-200b, mir-200c, mir-203, mir-205, mir-20a, mir-20b, mir-21, mir-217, mir-221, mir-222, mir-224, mir-23a, mir-24, mir-24-2-5p, mir-24-3p, mir-27a, mir-29a, mir-29b-1, mir-29b-2, mir-29c, mir-373, mir-378, mir-423, mir-429, mir-495, mir-503, mir-510, mir-520c, mir-526b, mir-96 |
| glioblastoma | mir-10b, mir-125b, mir-127-3p, mir-148a, mir-18a, mir-196a, mir-196a-1, mir-196a-2, mir-196b, mir-21, mir-210, mir-210-3p, mir-223, mir-340, mir-576-5p, mir-626, mir-92b |
| lung cancer | mir-10b, mir-135b, mir-150, mir-155, mir-17, mir-182, mir-183-3p, mir-18a, mir-197, mir-19a, mir-19b, mir-205, mir-20a, mir-21, mir-210, mir-24, mir-30d, mir-4423, mir-5100, mir-570, mir-663, mir-7, mir-92a |
| nasopharyngeal carcinoma | mir-10b, mir-144, mir-149, mir-155, mir-18a, mir-21, mir-214, mir-24, mir-421, mir-663, mir-744, mir-93 |
| non-small cell lung cancer | mir-10b, mir-125a-5p, mir-1280, mir-136, mir-140, mir-141, mir-142-3p, mir-145, mir-146a, mir-150, mir-18a, mir-196a, mir-19a, mir-200a, mir-200c, mir-205, mir-205-3p, mir-205-5p, mir-21, mir-212, mir-22, mir-221, mir-222, mir-24, mir-25, mir-29c, mir-31, mir-328, mir-330-3p, mir-339, mir-34a, mir-375, mir-494, mir-675-5p, mir-9, mir-92b, mir-93, mir-95 |
| oral cancer | mir-10b, mir-196a-1, mir-196a-2, mir-196b, mir-21 |
| pancreatic ductal adenocarcinoma | mir-10b, mir-186, mir-18a, mir-192, mir-194, mir-196a, mir-198, mir-203, mir-21, mir-212, mir-30b-5p, mir-31, mir-34a, mir-369-5p, mir-376a, mir-541 |
| renal clear cell carcinoma | mir-122, mir-155, mir-210, mir-630 |
| mantle cell lymphoma | mir-124a, mir-155, mir-17, mir-18a, mir-19a, mir-19b, mir-20a, mir-92a |
| acute myeloid leukemia | mir-125b, mir-126-5p, mir-128, mir-155, mir-29a, mir-32, mir-331, mir-370, mir-378 |
| follicular cancer | mir-125b |
| neuroblastoma | mir-125b, mir-15a, mir-15b, mir-16-1, mir-16-2, mir-18a, mir-195, mir-19a, mir-23a, mir-421, mir-92 |

TABLE 4-continued

Exemplary oncogenic miRs

| Cancer | miRNA |
|---|---|
| oral squamous cell carcinoma | mir-125b, mir-126, mir-146a, mir-146b, mir-155, mir-181b, mir-196a-1, mir-196a-2, mir-196b, mir-21, mir-221, mir-222, mir-24, mir-27b, mir-31, mir-345 |
| prostate cancer | mir-125b, mir-141, mir-153, mir-155, mir-181a-1, mir-181a-2, mir-181b, mir-181b-1, mir-181b-2, mir-181c, mir-181d, mir-182, mir-182-5p, mir-183, mir-18a, mir-204, mir-20a, mir-21, mir-221, mir-223-3p, mir-31, mir-429, mir-96 |
| mesenchymal cancer | mir-125b-1-3p, mir-182 |
| malignant melanoma | mir-126, mir-141, mir-15b, mir-17, mir-17-5p, mir-182, mir-18a, mir-193b, mir-200a, mir-200b, mir-200c, mir-20a, mir-21, mir-210, mir-214, mir-221, mir-222, mir-429, mir-455-5p, mir-532-5p, mir-638, mir-92a |
| acute lymphoblastic leukemia | mir-128 |
| osteosarcoma | mir-128, mir-151-3p, mir-17, mir-181a, mir-181b, mir-181c, mir-18a, mir-191, mir-195-5p, mir-199a-3p, mir-19a, mir-19b, mir-20a, mir-21, mir-210, mir-214, mir-221, mir-27a, mir-300, mir-320a, mir-374a-5p, mir-802, mir-9, mir-92a |
| colon cancer | mir-1290, mir-145, mir-155, mir-181a, mir-18a, mir-200c, mir-31, mir-675 |
| liver cancer | mir-1301, mir-155, mir-21, mir-221, mir-27a, mir-525-3p |
| cervical carcinoma | mir-133b, mir-21, mir-25, mir-373 |
| squamous carcinoma | mir-137, mir-155, mir-184, mir-196a, mir-203, mir-21, mir-221, mir-27a, mir-34a |
| chordoma | mir-140-3p, mir-148a |
| clear cell renal cell cancer | mir-142-5p, mir-155, mir-21-5p |
| malt lymphoma | mir-142-5p, mir-155 |
| anaplastic thyroid carcinoma | mir-146b, mir-221, mir-222 |
| follicular thyroid carcinoma | mir-146b, mir-183, mir-197, mir-221, mir-346 |
| primary thyroid lymphoma | mir-146b |
| ovarian carcinoma | mir-148b, mir-182 |
| adult t-cell leukemia | mir-150 |
| chronic lymphocytic leukemia | mir-150, mir-155 |
| lung adenocarcinoma | mir-150, mir-155, mir-31 |
| anaplastic large-cell lymphoma | mir-155 |
| cutaneous t-cell lymphoma | mir-155 |
| diffuse large B-cell lymphoma | mir-155, mir-21 |
| gallbladder carcinoma | mir-155, mir-182 |
| rectal cancer | mir-155, mir-200c, mir-21-5p, mir-34a |
| b-cell lymphoma | mir-17, mir-18a, mir-19a, mir-19b, mir-20a, mir-92a |
| breast carcinoma | mir-17, mir-18a, mir-19a, mir-19b, mir-20a, mir-24, mir-92a |
| cholangiocarcinoma | mir-17, mir-18a, mir-19a, mir-19b, mir-20a, mir-21, mir-26a, mir-92a |
| colorectal carcinoma | mir-17, mir-182, mir-191, mir-21, mir-95 |
| nasopharyngeal cancer | mir-17, mir-20a |
| acute promyelocytic leukemia | mir-181a, mir-181b, mir-92a |
| retinoblastoma | mir-181b, mir-21 |
| colorectal adenocarcinoma | mir-182 |
| kidney cancer | mir-183, mir-21, mir-210, mir-223 |
| medullary thyroid carcinoma | mir-183 |
| esophageal adenocarcinoma | mir-196a, mir-199a-3p, mir-199a-5p, mir-199b-3p, mir-200a, mir-223 |
| gastrointestinal stromal tumor | mir-196a |
| hypopharyngeal cancer | mir-203 |
| pancreatic adenocarcinoma | mir-203, mir-301a |
| cervical squamous cell carcinoma | mir-205 |
| adrenal cortical carcinoma | mir-21, mir-210, mir-483-3p, mir-483-5p |
| head and neck cancer | mir-21 |
| hypopharyngeal squamous cell carcinoma | mir-21 |
| laryngeal squamous cell carcinoma | mir-21, mir-9, mir-93 |
| multiple myeloma | mir-21 |
| colon carcinoma | mir-221, mir-23a |
| thyroid carcinoma | mir-221, mir-222 |

TABLE 4-continued

Exemplary oncogenic miRs

| Cancer | miRNA |
|---|---|
| meningioma | mir-224, mir-335 |
| gastric adenocarcinoma | mir-23a, mir-27a, mir-373 |
| laryngeal cancer | mir-23a |
| small cell lung cancer | mir-25 |
| pancreatic carcinoma | mir-30 1b |
| oral carcinoma | mir-31 |
| astrocytoma | mir-335 |
| epithelial ovarian cancer | mir-372, mir-373 |
| chronic myelogenous leukemia | mir-424, mir-96 |
| hepatoblastoma | mir-492 |

TABLE 3

Exemplary tumor suppressive miRs

| Cancer | Down regulated tumor suppressive miR |
|---|---|
| acute leukemia | mir-27a |
| acute lymphoblastic leukemia | let-7b, mir-124a, mir-142-3p |
| acute myeloid leukemia | let-7c, mir-17, mir-181a, mir-20a, mir-223, mir-26a, mir-29a, mir-30c, mir-720 |
| acute promyelocytic leukemia | let-7c, mir-107, mir-342 |
| adrenal cortical carcinoma | mir-195, mir-1974, mir-335, mir-497 |
| anaplastic astrocytoma | mir-124, mir-137 |
| anaplastic thyroid carcinoma | mir-138 |
| astrocytoma | mir-124-3p, mir-181b-5p, mir-200b, mir-3189-3p |
| basal cell carcinoma | mir-203 |
| b-cell lymphoma | mir-34a |
| bladder cancer | mir-1, mir-101, mir-1180, mir-1236, mir-124-3p, mir-125b, mir-126, mir-1280, mir-133a, mir-133b, mir-141, mir-143, mir-144, mir-145, mir-155, mir-16, mir-18a, mir-192, mir-195, mir-200a, mir-200b, mir-200c, mir-203, mir-205, mir-214, mir-218, mir-23b, mir-26a, mir-29c, mir-320c, mir-34a, mir-370, mir-409-3p, mir-429, mir-451, mir-490-5p, mir-493, mir-576-3p, mir-99a |
| breast cancer | let-7a, let-7a-1, let-7a-2, let-7a-3, let-7b, let-7c, let-7d, let-7e, let-7f-1, let-7f-2, let-7g, let-7i, mir-100, mir-107, mir-10a, mir-10b, mir-122, mir-124, mir-1258, mir-125a-5p, mir-125b, mir-126, mir-127, mir-129, mir-130a, mir-132, mir-133a, mir-143, mir-145, mir-146a, mir-146b, mir-147, mir-148a, mir-149, mir-152, mir-153, mir-15a, mir-16, mir-17-5p, mir-181a, mir-1826, mir-183, mir-185, mir-191, mir-193a-3p, mir-193b, mir-195, mir-199b-5p, mir-19a-3p, mir-200a, mir-200b, mir-200c, mir-205, mir-206, mir-211, mir-216b, mir-218, mir-22, mir-26a, mir-26b, mir-300, mir-30a, mir-31, mir-335, mir-339-5p, mir-33b, mir-34a, mir-34b, mir-34c, mir-374a, mir-379, mir-381, mir-383, mir-425, mir-429, mir-450b-3p, mir-494, mir-495, mir-497, mir-502-5p, mir-517a, mir-574-3p, mir-638, mir-7, mir-720, mir-873, mir-874, mir-92a, mir-98, mir-99a, mmu-mir-290-3p, mmu-mir-290-5p |
| bronchioloalveolar carcinoma | let-7a-1, let-7a-2, let-7a-3, let-7b, let-7c, let-7d, let-7e, let-7f-1, let-7f-2, let-7g, let-7i, mir-98 |
| cervical cancer | mir-143, mir-145, mir-17-5p, mir-203, mir-214, mir-218, mir-335, mir-342-3p, mir-372, mir-424, mir-491-5p, mir-497, mir-7, mir-99a, mir-99b |
| cervical carcinoma | mir-100, mir-101, mir-15a, mir-16, mir-34a, mir-886-5p, mir-99a, mir-99b |
| cervical squamous cell carcinoma | mir-106a, mir-124, mir-148a, mir-214, mir-218, mir-29a, mir-375 |
| cholangiocarcinoma | mir-101, mir-144, mir-200b, mir-200c |
| chondrosarcoma | let-7a, mir-100, mir-136, mir-145, mir-199a, mir-222, mir-30a, mir-335, mir-376a |
| chordoma | mir-1, mir-222, mir-31, mir-34a, mir-608 |
| choriocarcinoma | mir-199b, mir-218, mir-34a |
| chronic lymphocytic leukemia | mir-125b, mir-138, mir-15a, mir-15b, mir-16, mir-16-1, mir-16-1-3p, mir-16-2, mir-181a, mir-181b, mir-195, mir-223, mir-29b, mir-34b, mir-34c, mir-424 |
| chronic myelogenous leukemia | mir-10a, mir-138, mir-146a, mir-150, mir-151, mir-155, mir-16, mir-2278, mir-26a, mir-30e, mir-31, mir-326, mir-564 |
| clear cell renal cell cancer | mir-106a-5p, mir-135a-5p, mir-206 |
| colon cancer | let-7a-1, let-7a-2, let-7a-3, let-7b, let-7c, let-7d, let-7e, let-7f-1, let-7f-2, let-7g, let-7i, mir-100, mir-101, mir-126, mir-142-3p, mir-143, mir-145, mir-192, mir-200c, mir-21, mir-214, mir-215, mir-22, mir-25, mir-302a, mir-320, mir-320a, mir-34a, mir-34c, mir-365, mir-373, mir-424, mir-429, mir-455, mir-484, mir-502, mir-503, mir-93, mir-98 |

TABLE 3-continued

Exemplary tumor suppressive miRs

| Cancer | Down regulated tumor suppressive miR |
|---|---|
| colon carcinoma | mir-186, mir-30a-5p |
| colonic adenocarcinoma | mir-627 |
| colorectal cancer | let-7a, mir-1, mir-100, mir-101, mir-124, mir-125a, mir-126, mir-129, mir-1295b-3p, mir-1307, mir-130b, mir-132, mir-133a, mir-133b, mir-137, mir-138, mir-139, mir-139-5p, mir-140-5p, mir-143, mir-145, mir-148a, mir-148b, mir-149, mir-150-5p, mir-154, mir-15a, mir-15b, mir-16, mir-18a, mir-191, mir-192, mir-193a-5p, mir-194, mir-195, mir-196a, mir-198, mir-199a-5p, mir-200c, mir-203, mir-204-5p, mir-206, mir-212, mir-215, mir-218, mir-22, mir-224, mir-24-3p, mir-26b, mir-27a, mir-28-3p, mir-28-5p, mir-29b, mir-30a-3p, mir-30b, mir-320a, mir-328, mir-338-3p, mir-342, mir-345, mir-34a, mir-34a-5p, mir-361-5p, mir-375, mir-378, mir-378a-3p, mir-378a-5p, mir-409-3p, mir-422a, mir-4487, mir-483, mir-497, mir-498, mir-518a-3p, mir-551a, mir-574-5p, mir-625, mir-638, mir-7, mir-96-5p |
| colorectal carcinoma | mir-139, mir-143, mir-145, mir-202-3p, mir-30a, mir-338-3p, mir-429, mir-451, mir-93 |
| endometrial cancer | mir-101, mir-130a, mir-130b, mir-134, mir-143, mir-145, mir-152, mir-205, mir-223, mir-301a, mir-301b, mir-30c, mir-34a, mir-34c, mir-424, mir-449a, mir-543 |
| endometrial serous adenocarcinoma | mir-34b |
| epithelial ovarian cancer | mir-124a, mir-192, mir-193a, mir-7 |
| esophageal adenocarcinoma | mir-203 |
| esophageal cancer | mir-124, mir-126, mir-140, mir-197, mir-203, mir-218, mir-223, mir-30b, mir-375, mir-454, mir-486, mir-574-3p |
| esophageal carcinoma | mir-451 |
| esophageal squamous cell carcinoma | let-7a, let-7a-1, let-7a-2, let-7a-3, let-7b, let-7c, let-7d, let-7e, let-7f-1, let-7f-2, let-7g, let-7i, mir-1, mir-100, mir-101, mir-126, mir-1294, mir-133a, mir-133b, mir-138, mir-143, mir-145, mir-150, mir-185, mir-195, mir-200b, mir-203, mir-21, mir-210, mir-214, mir-218, mir-22, mir-27a, mir-29b, mir-29c, mir-302b, mir-34a, mir-375, mir-494, mir-518b, mir-655, mir-98, mir-99a |
| follicular lymphoma | mir-202 |
| follicular thyroid carcinoma | mir-199b |
| gallbladder carcinoma | mir-146b-5p |
| gastric adenocarcinoma | mir-181b, mir-182, mir-200a, mir-302b, mir-449a, mir-9 |
| gastric cancer | let-7a, let-7b, let-7g, mir-1, mir-101, mir-103a, mir-10a, mir-10b, mir-1207-5p, mir-122, mir-1228*, mir-124, mir-124-3p, mir-125a-3p, mir-126, mir-1266, mir-127, mir-1271, mir-129-1-3p, mir-129-2-3p, mir-129-3p, mir-129-5p, mir-133a, mir-133b, mir-137, mir-141, mir-143, mir-144, mir-145, mir-146a, mir-146a-5p, mir-148a, mir-148b, mir-149, mir-152, mir-155, mir-155-5p, mir-181a, mir-181b, mir-182, mir-183, mir-185, mir-194, mir-195, mir-197, mir-199a-3p, mir-200b, mir-200c, mir-202-3p, mir-204, mir-204-5p, mir-205, mir-206, mir-210, mir-212, mir-217, mir-218, mir-22, mir-23b, mir-24, mir-26a, mir-29a, mir-29a-3p, mir-29b, mir-29b-1, mir-29b-2, mir-29c, mir-30a-5p, mir-30b, mir-31, mir-328, mir-329, mir-331-3p, mir-335-5p, mir-338, mir-338-3p, mir-34a, mir-34b, mir-34c, mir-361-5p, mir-367, mir-375, mir-378, mir-409-3p, mir-410, mir-429, mir-433, mir-449, mir-449a, mir-490-3p, mir-494, mir-497, mir-503, mir-506, mir-513b, mir-520d-3p, mir-542-3p, mir-622, mir-625, mir-638, mir-663, mir-7, mir-874, mir-9 |
| gastrointestinal cancer | mir-122a, mir-148a, mir-152 |
| gastrointestinal stromal tumor | mir-218, mir-221, mir-222 |
| glioblastoma | let-7g-5p, mir-100, mir-101, mir-106a, mir-124, mir-124a, mir-125a, mir-125a-5p, mir-125b, mir-127-3p, mir-128, mir-129, mir-136, mir-137, mir-139-5p, mir-142-3p, mir-143, mir-145, mir-146b-5p, mir-149, mir-152, mir-153, mir-195, mir-21, mir-212-3p, mir-219-5p, mir-222, mir-29b, mir-31, mir-3189-3p, mir-320, mir-320a, mir-326, mir-330, mir-331-3p, mir-340, mir-342, mir-34a, mir-376a, mir-449a, mir-483-5p, mir-503, mir-577, mir-663, mir-7, mir-7-5p, mir-873 |
| glioma | let-7a, let-7f, mir-106a, mir-107, mir-122, mir-124, mir-124-5p, mir-124a, mir-125b, mir-128, mir-136, mir-137, mir-139, mir-143, mir-145, mir-146a, mir-146b, mir-146b-5p, mir-152, mir-15b, mir-16, mir-181a, mir-181a-1, mir-181a-2, mir-181b, mir-181b-1, mir-181b-2, mir-181c, mir-181d, mir-184, mir-185, mir-195, mir-199a-3p, mir-200a, mir-200b, mir-203, mir-204, mir-205, mir-218, mir-219-5p, mir-23b, mir-26b, mir-27a, mir-29c, mir-320, mir-326, mir-328, mir-34a, mir-34c-3p, mir-34c-5p, mir-375, mir-383, mir-451, mir-452, mir-483-5p, mir-495, mir-584, mir-622, mir-656, mir-7, mir-98 |
| head and neck squamous cell carcinoma | let-7d, mir-1, mir-107, mir-128, mir-133a, mir-138, mir-149, mir-200c, mir-205, mir-218, mir-27a*, mir-29a, mir-29b-1, mir-29b-2, mir-29c, mir-300, mir-34a, mir-363, mir-375, mir-874 |
| hepatocellular carcinoma | let-7a-1, let-7a-2, let-7a-3, let-7b, let-7c, let-7d, let-7e, let-7f, let-7f-1, let-7f-2, let-7g, let-7i, mir-1, mir-100, mir-101, mir-105, mir-122, mir-122a, mir-1236, mir-124, mir-125b, mir-126, mir-127, mir-1271, mir-128-3p, mir-129-5p, mir-130a, mir-130b, mir-133a, mir-134, mir-137, mir-138, mir-139, mir-139-5p, mir-140-5p, mir-141, mir-142-3p, mir-143, mir- |

TABLE 3-continued

Exemplary tumor suppressive miRs

| Cancer | Down regulated tumor suppressive miR |
|---|---|
| | 144, mir-145, mir-146a, mir-148a, mir-148b, mir-150-5p, mir-15b, mir-16, mir-181a-5p, mir-185, mir-188-5p, mir-193b, mir-195, mir-195-5p, mir-197, mir-198, mir-199a, mir-199a-5p, mir-199b, mir-199b-5p, mir-200a, mir-200b, mir-200c, mir-202, mir-203, mir-204-3p, mir-205, mir-206, mir-20a, mir-21, mir-21-3p, mir-211, mir-212, mir-214, mir-217, mir-218, mir-219-5p, mir-22, mir-223, mir-26a, mir-26b, mir-29a, mir-29b-1, mir-29b-2, mir-29c, mir-302b, mir-302c, mir-30a, mir-30a-3p, mir-335, mir-338-3p, mir-33a, mir-34a, mir-34b, mir-365, mir-370, mir-372, mir-375, mir-376a, mir-377, mir-422a, mir-424, mir-424-5p, mir-433, mir-4458, mir-448, mir-450a, mir-451, mir-485-5p, mir-486-5p, mir-497, mir-503, mir-506, mir-519d, mir-520a, mir-520b, mir-520c-3p, mir-582-5p, mir-590-5p, mir-610, mir-612, mir-625, mir-637, mir-675, mir-7, mir-877, mir-940, mir-941, mir-98, mir-99a |
| hypopharyngeal squamous cell carcinoma | mir-45 la, mir-504 |
| kidney cancer | mir-1, mir-145, mir-1826, mir-199a, mir-199a-3p, mir-203, mir-205, mir-497, mir-508-3p, mir-509-3p |
| laryngeal squamous cell carcinoma | mir-129-5p, mir-203, mir-205, mir-206, mir-24, mir-370, mir-375 |
| liver cancer | mir-101, mir-122, mir-132, mir-140-5p, mir-145, mir-148b, mir-31, mir-338-3p, mir-433 |
| lung adenocarcinoma | mir-1297, mir-141, mir-145, mir-16, mir-200a, mir-200b, mir-200c, mir-29b, mir-381, mir-409-3p, mir-429, mir-451, mir-511, mir-99a |
| lung cancer | let-7a-1, let-7a-2, let-7a-3, let-7b, let-7c, let-7d, let-7e, let-7f-1, let-7f-2, let-7g, let-7i, mir-1, mir-101, mir-133b, mir-138, mir-142-5p, mir-144, mir-145, mir-1469, mir-146a, mir-153, mir-15a, mir-15b, mir-16-1, mir-16-2, mir-182, mir-192, mir-193a-3p, mir-194, mir-195, mir-198, mir-203, mir-217, mir-218, mir-22, mir-223, mir-26a, mir-26b, mir-29c, mir-33a, mir-34a, mir-34b, mir-34c, mir-365, mir-449a, mir-449b, mir-486-5p, mir-545, mir-610, mir-614, mir-630, mir-660, mir-7515, mir-9500, mir-98, mir-99b |
| lung squamous cell carcinoma | mir-133a, mir-218 |
| malignant melanoma | let-7b, mir-101, mir-125b, mir-1280, mir-143, mir-146a, mir-146b, mir-155, mir-17, mir-184, mir-185, mir-18b, mir-193b, mir-200c, mir-203, mir-204, mir-205, mir-206, mir-20a, mir-211, mir-218, mir-26a, mir-31, mir-33a, mir-34a, mir-34c, mir-376a, mir-376c, mir-573, mir-7-5p, mir-9, mir-98 |
| malignant mesothelioma | mir-126 |
| mantle cell lymphoma | mir-142-3p, mir-142-5p, mir-150, mir-223, mir-29a, mir-29b, mir-29c |
| medullary thyroid carcinoma | mir-129-5p |
| medulloblastoma | mir-124, mir-128a, mir-199b-5p, mir-206, mir-22, mir-31, mir-383 |
| meningioma | mir-128, mir-200a |
| mesenchymal cancer | mir-100, mir-141, mir-199b-5p, mir-200a, mir-200b, mir-200c, mir-29a, mir-29b-1, mir-29b-1-5p, mir-29b-2, mir-29c, mir-335, mir-429, mir-99a |
| monocytic leukemia | mir-29a, mir-29b |
| multiple myeloma | mir-137, mir-197, mir-214 |
| nasopharyngeal cancer | mir-218, mir-223, mir-29c |
| nasopharyngeal carcinoma | let-7a, let-7a-1, let-7a-2, let-7a-3, let-7b, let-7c, let-7d, let-7e, let-7f-1, let-7f-2, let-7g, let-7i, mir-1, mir-101, mir-124, mir-138, mir-143, mir-145, mir-148a, mir-200b, mir-204, mir-216b, mir-223, mir-29c, mir-320a, mir-324-3p, mir-34c, mir-375, mir-378, mir-451, mir-506, mir-9, mir-98 |
| neuroblastoma | let-7a-1, let-7a-2, let-7a-3, let-7b, let-7c, let-7d, let-7e, let-7f-1, let-7f-2, let-7g, let-7i, mir-124, mir-137, mir-145, mir-181c, mir-184, mir-200a, mir-29a, mir-335, mir-338-3p, mir-34a, mir-449a, mir-885-5p, mir-98 |
| non-small cell lung cancer | let-7a, let-7c, mir-1, mir-100, mir-101, mir-106a, mir-107, mir-124, mir-125a-3p, mir-125a-5p, mir-126, mir-126*, mir-129, mir-133a, mir-137, mir-138, mir-140, mir-143, mir-145, mir-146a, mir-146b, mir-148a, mir-148b, mir-149, mir-152, mir-153, mir-154, mir-155, mir-15a, mir-16, mir-17-5p, mir-181a-1, mir-181a-2, mir-181b, mir-181b-1, mir-181b-2, mir-181c, mir-181d, mir-184, mir-186, mir-193b, mir-195, mir-199a, mir-204, mir-212, mir-221, mir-224, mir-26b, mir-27a, mir-27b, mir-29a, mir-29b, mir-29c, mir-30a, mir-30b, mir-30c, mir-30d, mir-30d-5p, mir-30e-5p, mir-32, mir-335, mir-338-3p, mir-340, mir-342-3p, mir-34a, mir-34b, mir-361-3p, mir-365, mir-373, mir-375, mir-429, mir-449a, mir-4500, mir-451, mir-4782-3p, mir-497, mir-503, mir-512-3p, mir-520a-3p, mir-526b, mir-625*, mir-96, mir-99a |
| oral cancer | let-7d, mir-218, mir-34a, mir-375, mir-494 |
| oral carcinoma | mir-375 |
| oral squamous cell carcinoma | mir-100, mir-124, mir-1250, mir-125b, mir-126, mir-1271, mir-136, mir-138, mir-145, mir-147, mir-148a, mir-181a, mir-206, mir-220a, mir-26a, mir-26b, mir-29a, mir-32, mir-323-5p, mir-329, mir-338, mir-370, mir-410, mir-429, mir-433, mir-499a-5p, mir-503, mir-506, mir-632, mir-646, mir-668, mir-877, mir-9 |
| osteosarcoma | let-7a, mir-1, mir-100, mir-101, mir-122, mir-124, mir-125b, mir-126, mir-127-3p, mir-132, mir-133a, mir-141, mir-142-3p, mir-142-5p, mir-143, mir-144, mir-145, mir-153, mir-16, mir-183, mir-194, mir-195, mir-199a-3p, mir-204, mir-212, mir-217, mir-218, mir-22, mir-23a, mir-24, |

TABLE 3-continued

Exemplary tumor suppressive miRs

| Cancer | Down regulated tumor suppressive miR |
|---|---|
| | mir-26a, mir-26b, mir-29b, mir-32, mir-320, mir-335, mir-33b, mir-340, mir-34a, mir-34b, mir-34c, mir-375, mir-376c, mir-382, mir-3928, mir-424, mir-429, mir-449a, mir-451, mir-454, mir-503, mir-519d, mir-646 |
| ovarian cancer | let-7i, mir-100, mir-124, mir-125b, mir-129-5p, mir-130b, mir-133a, mir-137, mir-138, mir-141, mir-145, mir-148a, mir-152, mir-153, mir-155, mir-199a, mir-200a, mir-200b, mir-200c, mir-212, mir-335, mir-34a, mir-34b, mir-34c, mir-409-3p, mir-411, mir-429, mir-432, mir-449a, mir-494, mir-497, mir-498, mir-519d, mir-655, mir-9, mir-98 |
| ovarian carcinoma | mir-100, mir-101, mir-34b, mir-34c, mir-532-5p |
| pancreatic cancer | mir-101, mir-1181, mir-124, mir-1247, mir-133a, mir-141, mir-145, mir-146a, mir-148a, mir-148b, mir-150*, mir-150-5p, mir-152, mir-15a, mir-198, mir-203, mir-214, mir-216a, mir-29c, mir-335, mir-34a, mir-34b, mir-34c, mir-373, mir-375, mir-410, mir-497, mir-615-5p, mir-630, mir-96 |
| pancreatic carcinoma | mir-132, mir-375 |
| pancreatic ductal adenocarcinoma | let-7a, let-7a-1, let-7a-2, let-7a-3, let-7b, let-7c, let-7d, let-7e, let-7f-1, let-7f-2, let-7g, let-7i, mir-126, mir-135a, mir-143, mir-144, mir-145, mir-148a, mir-150, mir-15a, mir-16, mir-200a, mir-200b, mir-200c, mir-217, mir-218, mir-337, mir-375, mir-494, mir-615-5p, mir-98 |
| papillary thyroid carcinoma | mir-101, mir-130b, mir-138, mir-146a, mir-16, mir-195, mir-199a-3p, mir-204-5p, mir-219-5p, mir-26a, mir-34b, mir-613 |
| primary cns lymphomas | mir-145, mir-193b, mir-199a, mir-214 |
| primary gallbladder carcinoma | mir-335 |
| primary thyroid lymphoma | mir-26a |
| prostate cancer | let-7a-3p, let-7c, mir-100, mir-101, mir-105, mir-124, mir-128, mir-1296, mir-130b, mir-133a-1, mir-133a-2, mir-133b, mir-135a, mir-143, mir-145, mir-146a, mir-154, mir-15a, mir-187, mir-188-5p, mir-199b, mir-200b, mir-203, mir-205, mir-212, mir-218, mir-221, mir-224, mir-23a, mir-23b, mir-25, mir-26a, mir-26b, mir-29b, mir-302a, mir-30a, mir-30b, mir-30c-1, mir-30c-2, mir-30d, mir-30e, mir-31, mir-330, mir-331-3p, mir-34a, mir-34b, mir-34c, mir-374b, mir-449a, mir-4723-5p, mir-497, mir-628-5p, mir-642a-5p, mir-765, mir-940 |
| prostate carcinoma | mir-107 |
| renal cell carcinoma | let-7a, let-7d, mir-1, mir-106a*, mir-126, mir-1285, mir-129-3p, mir-1291, mir-133a, mir-135a, mir-138, mir-141, mir-143, mir-145, mir-182-5p, mir-199a-3p, mir-200a, mir-205, mir-218, mir-28-5p, mir-30a, mir-30c, mir-30d, mir-34a, mir-378, mir-429, mir-509-3p, mir-509-5p, mir-646 |
| renal clear cell carcinoma | let-7b, let-7c, mir-138, mir-141, mir-200c, mir-204, mir-218, mir-335, mir-377, mir-506 |
| retinoblastoma | mir-101, mir-183, mir-204, mir-34a, mir-365b-3p, mir-486-3p, mir-532-5p |
| rhabdomyosarcoma | mir-203 |
| small cell lung cancer | mir-126, mir-138, mir-27a |
| splenic marginal zone lymphoma | mir-223 |
| squamous carcinoma | mir-15a, mir-16, mir-203, mir-205, mir-375 |
| t-cell lymphoma | mir-22 |
| thyroid cancer | mir-144, mir-886-3p |
| tongue cancer | mir-15b, mir-200b |
| uterine leiomyoma | mir-197 |
| uveal melanoma | mir-137, mir-144, mir-145, mir-182, mir-34a, mir-34b, mir-34c, mir-9 |

TABLE 5

Summary of microRNA/MMP linked interactions in cancer.

| microRNA | MMP Type and target molecule | Cancer type | Phenotype | Pathway |
|---|---|---|---|---|
| let-7 | MMP-9 | Melanoma | Cell proliferation and migration | — |
| | MMP-14, ERK1/2 activation | Pancreatic ductal adenocarcinoma | NA | ERK1/2 activation, TGF-β1 signaling |
| | Focal adhesion kinase (FAK), AKT, ERK, MMP-2 and MMP-9 | Glioblastoma | Migration and invasion | AKT and ERK |
| miR-9 | MMP-2, MMP-9 and VEGFA | Uveal melanoma | Migration and invasion | NF-κB1 signaling |
| | MMP-14 | Neuroblastoma | Invasion, metastasis, and angiogenesis | — |
| miR-10b | MMP-9, E-cadherin and vimentin | Nasopharyngeal carcinoma cells | Proliferation, migration, invasion | — |
| | MMP-14 and uPAR | Glioma | Cell invasiveness | — |

TABLE 5-continued

Summary of microRNA/MMP linked interactions in cancer.

| microRNA | MMP Type and target molecule | Cancer type | Phenotype | Pathway |
| --- | --- | --- | --- | --- |
| | MMP-2, EGFR. | Glioblastoma multiforme | Apoptosis invasion and migration | EGFR pathways |
| miR-15b | MMP-3 | Glioma | Cell invasiveness | MEK-ERK pathway |
| miR-17 | MMP-3 | Hepatocellular carcinoma | Migration and invasion | p-AKT |
| miR-21 | RECK, MMP-9 | Prostate cancer | NA | — |
| | Phospho-c-Jun, MMP-2, MMP-9 | Hepatocellular carcinoma | Migration and invasion | — |
| | RECK, MMP-2 | Glioma | Apoptosis, migration, and invasiveness | — |
| | MMP-2, EGFR. | Glioblastoma multiforme | Apoptosis invasion and migration | EGFR pathways |
| miR-26a | MMP-2 | Lung cancer | Migration, invasion and metastasis | AKT phosphorylation |
| miR-29b | MMP-2 | Colon cancer | Migration | — |
| | MMP-2 | Hepatocellular carcinoma | Tumor angiogenesis, invasion, and metastasis | VEGFR-2-signaling |
| | MMP-2, Mcl-1, COL1A1, and COL4A1 | Prostate cancer | invasion and metastasis | — |
| miR-29c | MMP-2 | Nerve sheath tumours | Cell invasion and migration | — |
| miR-30d | SOCS1, phospho-STAT3, MMP-2 and MMP-9 | Prostate cancer | Proliferation and invasion | STAT3 signalling |
| miR-34a | Fra-1, p53 MMP-1 and MMP-9 | Colon cancer | Migration and invasion | — |
| miR-92a | MMP-2 and -9 | Lung cancer | Migration and invasion | STAT3 signaling |
| miR-101 | Enhancer of zeste homolog 2 (EZH2), CDH1 and MMP-2 | Lung cancer | Cell invasiveness | — |
| miR-106b | MMP-2 | Breast cancer | Migration and invasion | ERK signaling cascade |
| miR-125b | MMP-2 and MMP-9 | Glioblastoma | Invasion | — |
| miR-133 | MMP-14 | Lung cancer | Cell proliferation, migration and invasion | — |
| miR-138 | RhoC, MMP-2 and MMP-9 | Cholangiocarcinoma | Proliferation, migration and invasion | p-ERK signaling |
| miR-139 | IGF-IR and MMP-2 | Colorectal cancer | Migration, invasion and metastasis | IGF-IR/MEK/ERK signaling |
| miR-143 | MMP-13 | Prostate cancer | Migration and invasion | — |
| | MMP-2 and MMP-9 | Pancreatic cancer | Migration and invasion | — |
| | MMP-13 | Osteosarcoma | Cell invasiveness | — |
| miR-145 | Ets1, MMP-1 and -9 | Gastric cancer | Invasion, metastasis, and angiogenesis | — |
| miR-146a | MMP-1, uPA, and uPAR | Brain cancer | Migration, invasion and metastasis | — |
| | MMP-16 | Colon cancer | Invasion | — |
| miR-149 | M MP-2 and CyclinD1 | Glioma | Proliferation and invasion | AKT signaling |
| miR-152 | MMP-3 | Glioma | Cell invasiveness | MEK-ERK pathway |
| miR-18lb | MMP-2 and MMP-9 | Hepatocellular carcinomas | Migration and invasion | TGF-β, Smad signaling |
| miR-182 | MMP-9, RECK | Breast cancer | cell invasion and colony formation ability | — |
| miR-196b | Vimentin, MMP-2 and MMP-9 | Gastric cancer | Migration and invasion | — |
| miR-203 | MMP-9 and Robo1 | Glioblastoma | Proliferation, migration, and invasion | ERK phosphorylation |
| miR-206 | MMP-2 and MMP-9 | Breast cancer | Invasion and migration | — |
| miR-211 | MMP-9 | Glioblastoma multiforme | Cell invasion and migration | — |
| miR-218 | LEF1, MMP-2, -7 and -9 | Glioblastoma multiforme | Invasion | — |
| miR-218 | MMP-9 | Gliomas | Cell invasiveness | IKK-β/NF-κB pathway |
| miR-224 | MMP-9 via targeting HOXD10 | Human hepatocellular carcinoma | Migration and invasion | — |
| miR-338-3p | SMO and MMP-9 | Hepatocellular carcinoma | Invasion and metastasis | — |
| miR-340 | MMP-2 and MMP-9 | Breast cancer | Tumor cell growth, migration, and invasion | — |
| miR-430 | ERK, MMP-2 and MMP-9 | Bladder cancer | Proliferation, migration and colony formation ablility | — |
| miR-451 | Akt1, CyclinD1, MMP-2, MMP-9 and Bcl-2 | Glioblastoma | Proliferation, invasion and apoptosis | PI3K/AKT signaling |
| miR-491 | MMP-9 | Hepatocellular carcinoma | Migration | — |

TABLE 5-continued

Summary of microRNA/MMP linked interactions in cancer.

| microRNA | MMP Type and target molecule | Cancer type | Phenotype | Pathway |
|---|---|---|---|---|
| miR-491-5p | MMP-9 | Glioblastoma multiforme | Invasion | — |
| miRNA-590-3p | PI3K, Akt, MMP-2 and MMP-9 | Bladder cancer | Proliferation, migration and colony-formation | PI3K, Akt signaling |
| miR-874 | MMP-2 and -9, Aquaporin-3 | Human gastric cancer | Cell migration and invasion assays and in vivo tumorigenicity | — |
| miR-874 | MMP-2 and uPA | Non-small cell lung cancer | Tumor cell invasiveness and in vivo tumor growth | — |
| miR-885-5p | MMP-9 | Glioblastoma multiforme | Invasion | — |

TABLE 6

Target proteases and cancers associated with their overexpression.

| Family | Protease | Location | Cancer |
|---|---|---|---|
| Cysteine Cathepsins | General | Intracellular, lysosomes | Most |
| | Cathepsin K | Extracellular, bone | Breast |
| | Cathepsin B | Extracellular and pericellular under pathological conditions | Breast, cervix, colon, colorectal, gastric, head and neck, liver, lung, melanoma, ovarian, pancreatic, prostate, thyroid |
| | Cathepsin L | | Breast, colorectal |
| Aspartic Cathepsins | Cathepsin E | Endosomal structures, ER, Golgi | Cervical, gastric, lung, pancreas adenocarcinomas |
| | Cathepsin D | Lysosome | Breast, colorectal, ovarian |
| Kallikreins (hK) | General hK1 | Intracellular, secreted | Most |
| | PSA (hK 3) | | Prostate, ovarian |
| | hK10 | | Colon, ovarian, pancreatic, head and neck |
| | hK15 | | Ovarian, prostate |
| Serine Proteases | uPA, uPAR | Membrane, Pericellular | Cervical, colorectal, gastric, prostate |
| Caspases | | Intracellular | |
| MMPs | General | Extracellular | Most |
| | MMP-1, -8, -13 | | Breast |
| | MMP-2, -9 | | Breast, colorectal, lung, malignant gliomas, ovarian |
| | MMP-14 | Membrane | Breast |
| ADAM | | Extracellular | |

TABLE 7

List of selected oncogenes associated with human malignancy

| Gene Name | Gene Locus | Malignancies associated with | Comments |
|---|---|---|---|
| ABL1 (ABL) | 9q34.1 | Chronic myeloid leukemia | see tyrosine kinase Abelson murine leukemia protein |
| ABL2 (ABLL, ARG) | 1q24-q25 | acute myeloid leukemia | Member of the tyrosine kinase family. Important for synapse assembly and remodeling |
| AKAP13 (HT31, LBC. BRX) | 15q24-q25 | breast cancer | Blast crisis oncogene |
| ARAF1 | Xp11.4-p11.2 | angioimmunoblastic lymphadenopathy with dysproteinemia | Serine/threonine kinase |
| ARHGEF5 (TIM) | 7q33-q35 | Breast cancer | Codes for protein that controls cytoskeletal organization through regulation of small GTP-binding proteins |
| ATF1 | 12q13 | ATF1/EWS fusion gene associated with malignant melanoma of soft parts (MMSP) ATF1/FUS with histiocytoma. | Codes for cAMP-dependent transcription factor-1 |

TABLE 7-continued

List of selected oncogenes associated with human malignancy

| Gene Name | Gene Locus | Malignancies associated with | Comments |
|---|---|---|---|
| AXL | 19q13.1-q13.2 | Chronic myelogenous leukemia | transforming gene to acute leukemia |
| BCL2 | 18q21.3 | Burkitt lymphoma, follicular lymphoma | Mediator of apoptosis. Translocation is marker of poorer therapeutic response |
| BRAF (BRAF1, RAFB1) | 7q34 | Hairy cell leukemia, Malignant melanoma, thyroid papillary cancer, thyroid anaplastic carcinoma, bowel cancer, adenocarcinoma of lung, non-Hogkins lymphoma | see proto-oncogenes |
| BRCA1 | 17q21 | Hereditary breast-ovarian cancer syndrome. Familial Breast cancer, Papillary serous carcinoma of the peritoneum (PSCP), Prostate cancer | see BRCA1. |
| BRCA2(FANCD1) | 13q12.3 | Familial Breast cancer, prostate cancer, pancreatic cancer | see BRCA2 |
| BRIP1 | 17q22.2 | Ovarian cancer, breast cancer | BRCA1 interacting protein C-terminal helicase 1 which is important in normal double-strand break repair |
| CBL (CBL2) | 11q23.3 | | see proto-oncogenes |
| CSF1R (CSF-1, FMS, MCSF) | 5q33.2-q33.3 | Type M4 acute myeloblastic leukemia and chronic myelomonocytic leukemia | Codes for colony-stimulating factor-1 receptor, otherwise known as macrophage colony-stimulating factor |
| DAPK1 (DAPK) | 9q34.1 | Bladder cancer | Codes for death-associated protein kinase a positive mediators of apoptosis induced by gamma-interferon. |
| DEK (D6S231E) | 6p23 | DEK/NUP214(DEK/CAN) fusion gene associated with acute myeloid leukemia | Codes for DNA binding protein involved in transcriptional regulation and signal transduction as a component of the splicing complex that remains associated with spliced exons. |
| DUSP6 (MKP3, PYST1) | 12q22-q23 | Non-small cell lung cancer, pancreatic cancer | Codes for member of mitogen-activated protein (MAP) kinase family and has key role in cellular signal transduction |
| EGF | | | see proto-oncogenes |
| EGFR (ERBB, ERBB1) | | | see proto-oncogenes |
| ERBB3 (HER3) | 12q13 | Non-small cell lung cancer | elevated ERBB3 mRNA levels in breast cancer |
| ERG | | | see proto-oncogenes |
| ETS1 | | | see proto-oncogenes |
| ETS2 | | Acute myeloid leukemia | Codes for a transcription factor |
| EWSR1 (EWS, ES, PNE,) | 22q12 | EWS/ERG in Ewing sarcoma, esthesioneuroblastoma EWS/FEV fusion gene in Ewing sarcoma, EWS/ZNF278 in small round cell sarcoma, EWS/FLI1 in Ewing sarcoma, EWS/ATF1 in malignant melanoma of soft parts (MMSP) EWS/WT1 in desmoplastic small round cell tumor | Ewing sarcoma breakpoint 1 gene |
| FES (FPS) | 15q26.1 | B cell lymphoma, acute promyelocytic leukemia, bladder carcinoma, lung cancer, breast cancer, colon cancer, neuroblastoma, pre-B lymphocyte neoplasm, plasmacytoma, multiple myeloma, T cell lymphoma, sarcoma | Codes for a tyrosine-specific protein kinase with a role in regulating immune response |
| FGF4 (HSTF1, KFGF) | 11q13 | Stomach cancer, kaposi sarcoma | A fibroblast growth factor Important in limb development. |
| FGFR1 | | | see proto-oncogenes |
| FGFR1OP (FOP) | 6q27 | FGFR1/FGFR1OP2 fusion gene in non-Hodgkin lymphoma | |

TABLE 7-continued

List of selected oncogenes associated with human malignancy

| Gene Name | Gene Locus | Malignancies associated with | Comments |
|---|---|---|---|
| FLCN | 17p11.2 | Renal cancer, bowel cancer | see FFCN |
| FOS (c-fos) | 14q24.3 | | see proto-oncogenes |
| FRAP1 | | | see tumor suppressors |
| FUS (TLS) | 16p11.2 | | see proto-oncogenes |
| HRAS | 11p15.5 | | see proto-oncogenes. |
| GLI1 | 12q13.2-q13.3 | Glioma, myxoid liposarcoma, salivary gland tumor | Codes for a Kruppel (Kr) zinc finger protein |
| GLI2 | 2q14 | Glioma | Codes for a Kruppel (Kr) zinc finger protein |
| GPC3 | Xq26 | Germ cell cancer, Hepatocellular cancer | see GPC3 |
| HER2 (ERBB2, TKR1, NEU) | 17q21.1 | Breast cancer, lung cancer | see HER2. Targeted by Trastuzumab. |
| HGF (SF) | 7q21.1 | Prostate cancer, renal cancer | Codes for hepatocyte growth factor (hepatopoietin A, scatter factor) which is upregulated in many malignancies |
| IRF4 (LSIRF, MUM1) | 6p25-p23 | B-cell lymphoma, B-cell leukemia, Multiple myeloma | Codes for an interferon regulatory factor essential for lymphocyte function |
| JUNB | 19p13.2 | | see proto-oncogenes |
| KIT(SCFR) | 4q12 | Gastrointestinal stromal tumor (GISTs), mast cell leukemia, mastocytosis, seminoma and dysgerminoma | Transmembrane tyrosine kinase receptor for stem cell factor (SCFR) is required for haematopoiesis, melanogenesis and gametogenesis. Mutations cause piebaldism. |
| KRAS2 (RASK2) | 12p12.1 | | see proto-oncogenes. |
| LCK | 1p35-p34.3 | Non-small cell lung cancer, Neuroblastoma, non-Hodgkin lymphoma | codes for lymphocyte specific protein tyrosine kinase |
| LCO | 2q14-q21 | Hepatocellular carcinoma | |
| MAP3K8(TPL2, COT, EST) | 10p11.2 | Ewings sarcoma, adenocarcinoma of lung, thyroid carcinoma | Codes for a serine-threonine protein kinase. |
| MCF2 (DBL) | Xq27 | Breast cancer | Codes for a GDP-GTP exchange factor that modulates the activity of small GTPases of the Rho family |
| MDM2 | 12q14.3-q15 | Multiple | MDM2 acts as a major regulator of the tumor suppressor p53 by targeting its destruction. Direct association of p53 with the protein MDM2 results in ubiquitination and subsequent degradation of p53 |
| MET(HGFR, RCCP2) | 7q31 | | see proto-oncogenes |
| MLH type genes | | | see proto-oncogenes |
| MMD | 17q | Non small cell lung cancer, hepatocellular carcinoma, colon cancer | Codes for monocyte to macrophage differentiation associated protein. |
| MOS (MSV) | 8q11 | Burkitt lymphoma, acute myeloblastic leukemia | Function in man unknown. Above associations indirect but analogous gene to Moloney murine sarcoma virus. |
| MRAS (RRAS3) | 3q22.3 | Activated in many tumors | Codes for a RAS GTP-binding protein membrane-anchored, intracellular signal transducer |
| MSH type genes | | | see proto-oncogenes |
| MYB (AMV) | 6q22 | Alterations found in more than a third of human solid tumor lines | Encodes for proteins critical to hematopoietic cell proliferation and development |
| MYC | 8q24.12-q24.13 | Burkitt lymphoma Over expression in many malignancies, possibly associated with angiogenic, invasive promoting properties in excess. | A transcription factor that promotes cell proliferation |
| MYCL1 (LMYC) | 1p34.3 | Small cell lung cancer, adenocarcinoma of lung, neuroblastoma | |
| MYCN | 2p24.1 | Neuroblastomas | Overlaps with NMYC and is transcribed from opposite DNA strand |

TABLE 7-continued

List of selected oncogenes associated with human malignancy

| Gene Name | Gene Locus | Malignancies associated with | Comments |
|---|---|---|---|
| NCOA4 (ELE1, ARA70, PTC3) | 10q11.2 | Prostate cancer | Interacts with the androgen receptor in presence of dihydrotestosterone. |
| NF1 type genes | | | see tumor suppressors |
| NMYC | 2p24 | Neuroblastomas, retinoblastoma | Overlaps with MYCN and is transcribed from opposite DNA strand. Probably a DNA-binding protein. |
| NRAS | 1p13.2 | | see proto-oncogenes. |
| NTRK1 (TRK, TRKA) | 1q21-q22 | | see proto-oncogenes. |
| NUP214 (CAN, D9546E) | 9q34.1 | NUP214/DEK fusion gene associated with acute myeloid leukemia, NUP214/ABL1 associated with T-cell acute lymphoblastic leukemia (T-ALL). | Codes for nucleoporin component of the vertebrate nuclear pore complex. |
| OVC | 9p24 | Ovarian adenocarcinoma | Abnormal in about 40% ovarian adenocarcinoma |
| TP53 (P53) | 17p13.1 | | see tumor suppressors |
| PALB2 | 16p12 | Breast cancer | see PALB2 |
| PAX3 (HUP2) | 2q35 | Alveolar rhabdomyosarcoma | Transcriptions factor, causes some forms of Waardenburg syndrome and regulates RET. |
| STAT1 | | | |
| PDGFB (SIS) | | | see proto-oncogenes |
| PIM genes | | | see proto-oncogenes |
| PML (MYL) | 15q22 | | see tumour suppressors |
| PMS (PMSL) genes | | | see tumour suppressors |
| PPM1D (WIP1) | 17q22-q23 | Breast cancer, Osteosarcoma | Codes for a serine/threonine protein phosphatase that attenuates apoptosis and facilitates transformation of primary cells in cooperation with RAS |
| PTEN (MMAC1) | 10q23.31 | | see tumor suppressors |
| PVT1 | 8q24 | Burkitt lymphoma | |
| RAF1 (CRAF) | 3p25 | Stomach cancer, renal cancer, glioblastoma, laryngeal cancer | A regulator of endothelial cell survival during angiogenesis. Activated RAF counteracts apoptosis by suppressing the activation of mammalian sterile 20-like kinase (MST2). |
| RB1 (RB) | 13q14.1-q14.2 | Retinoblastoma, osteogenic sarcoma, small cell carcinoma of lung, bladder cancer | see RB1 |
| RET | 10q11.2 | Multiple endocrine neoplasia type 2a and 2b and Medullary thyroid carcinoma | see RET |
| RRAS2 (TC21) | 11pter-p15.5 | Teratocarcinoma, ovarian cancer | Single point mutation activates its oncogene potential |
| ROS1 (ROS, MCF3) | 6q22 | Glioblastoma and probably others | ROS1/FIG fusion protein is a tyrosine kinase found in astrocytoma |
| SMAD type genes | | | see tumor suppressors |
| SMARCB1 (SNF5, INI1) | 22q11 | | see tumor suppressors |
| SMURF1 | 7q21.1-q31.1 | Pancreatic cancer | Codes for a HECT domain E3 ubiquitin ligase that regulates tumor cell plasticity and motility through degradation of RhoA |
| SRC (AVS) | 20q12-q13 | hepatic metastatic bowel cancer, colon cancer, leukemia | Intracellular communication regulator protein. Mutations are activating, transforming, tumorigenic, and metastasis-promoting |
| STAT1 | 2q32.2-q32.3 | Non-small cell lung cancer | see STAT1 |
| STAT3 | 17q21 | Epithelial cancers | Codes signal protein that induces cell transformation through a combined inhibition of apoptosis and cell-cycle activation |
| STAT5 | 17q11.2 | Permissive for a wide range of malignancies | Codes signal protein that induces cell transformation through a combined inhibition of apoptosis and cell-cycle activation |
| TDGF1 (CRGF) | 3p23-p21 | teratocarcinoma | Probably codes for signaling protein for mesoderm development |

TABLE 7-continued

List of selected oncogenes associated with human malignancy

| Gene Name | Gene Locus | Malignancies associated with | Comments |
|---|---|---|---|
| TGFBR2 | 3p22 | | see proto-oncogenes |
| THRA (ERBA, EAR7 etc) | | | see proto-oncogenes |
| TFG (TRKT3) | 3q11-q12 | Papillary thyroid carcinoma | Chimeric oncogene with NTRK1 proto-oncogene |
| TIF1 (TRIM24, TIF1A) | 7q32-q34 | Fusion genes associated with papillary thyroid carcinoma and myleoproliferative disorder. | Codes for transcriptional intermediary factor 1 |
| TNC (TN, HXB) | 9q33 | Neurofibromatosis type 1, Pancreatic cancer | see TNC |
| TRK | 1q21-q22 | | see proto-oncogenes |
| TUSC3 | 8p22 | | see tumor suppressors |
| USP6 (TRE2) | 17p13 | Multiple cancers | Codes for a ubiquitin-specific protease found only in primates |
| WNT1 (INT1) | 12q12-q13 | | see proto-oncogenes |
| WT1 | 11p13 | Wilms tumour, over expressed in breast and lung cancer, myelodysplastic syndrome and acute myeloid leukemia | A zinc finger DNA-binding protein acting as a transcriptional activator or repressor depending on intracellular context |
| VHL | 3p26-p25 | | see tumor suppressors |

TABLE 8

Tumor suppresor miRs that are downregulated in specific cancer types

| Cancer | miRNA |
|---|---|
| Bladder | mir-1; mir-101; mir-1180; mir-1236; mir-124-3p; mir-125b; mir-126; mir-1280; mir-133a; mir-133b; mir-141; mir-143; mir-144; mir-145; mir-155; mir-16; mir-18a; mir-192; mir-195; mir-200a; mir-200b; mir-200c; mir-203; mir-205; mir-214; mir-218; mir-23b; mir-26a; mir-29c; mir-320c; mir-34a; mir-370; mir-409-3p; mir-429; mir-451; mir-490-5p; mir-493; mir-576-3p; mir-99a |
| Brain (Astrocytoma, Glioblastoma, Glioma) | let-7g-5p; mir-100; mir-101; mir-106a; mir-124; mir-124a; mir-125a; mir-125a-5p; mir-125b; mir-127-3p; mir-128; mir-129; mir-136; mir-137; mir-139-5p; mir-142-3p; mir-143; mir-145; mir-146b-5p; mir-149; mir-152; mir-153; mir-195; mir-21; mir-212-3p; mir-219-5p; mir-222; mir-29b; mir-31; mir-3189-3p; mir-320; mir-320a; mir-326; mir-330; mir-331-3p; mir-340; mir-342; mir-34a; mir-376a; mir-449a; mir-483-5p; mir-503; mir-577; mir-663; mir-7; mir-7-5p; mir-873; let-7a; let-7f; mir-107; mir-122; mir-124-5p; mir-139; mir-146a; mir-146b; mir-15b; mir-16; mir-181a; mir-181a-1; mir-181a-2; mir-181b; mir-181b-1; mir-181b-2; mir-181c; mir-181d; mir-184; mir-185; mir-199a-3p; mir-200a; mir-200b; mir-203; mir-204; mir-205; mir-218; mir-23b; mir-26b; mir-27a; mir-29c; mir-328; mir-34c-3p; mir-34c-5p; mir-375; mir-383; mir-451; mir-452; mir-495; mir-584; mir-622; mir-656; mir-98; mir-124-3p; mir-181b-5p; mir-200b; mir-3189-3p |
| Breast | mir-193b; let-7a; let-7a-1; let-7a-2; let-7a-3; let-7b; let-7c; let-7d; let-7e; let-7f-1; let-7f-2; let-7g; let-7i; mir-100; mir-107; mir-10a; mir-10b; mir-122; mir-124; mir-1258; mir-125a-5p; mir-125b; mir-126; mir-127; mir-129; mir-130a; mir-132; mir-133a; mir-143; mir-145; mir-146a; mir-146b; mir-147; mir-148a; mir-149; mir-152; mir-153; mir-15a; mir-16; mir-17-5p; mir-181a; mir-1826; mir-183; mir-185; mir-191; mir-193a-3p; mir-195; mir-199b-5p; mir-19a-3p; mir-200a; mir-200b; mir-200c; mir-205; mir-206; mir-211; mir-216b; mir-218; mir-22; mir-26a; mir-26b; mir-300; mir-30a; mir-31; mir-335; mir-339-5p; mir-33b; mir-34a; mir-34b; mir-34c; mir-374a; mir-379; mir-381; mir-383; mir-425; mir-429; mir-450b-3p; mir-494; mir-495; mir-497; mir-502-5p; mir-517a; mir-574-3p; mir-638; mir-7; mir-720; mir-873; mir-874; mir-92a; mir-98; mir-99a; mmu-mir-290-3p; mmu-mir-290-5p |
| Cervical | mir-143; mir-145; mir-17-5p; mir-203; mir-214; mir-218; mir-335; mir-342-3p; mir-372; mir-424; mir-491-5p; mir-497; mir-7; mir-99a; mir-99b; mir-100; mir-101; mir-15a; mir-16; mir-34a; mir-886-5p; mir-106a; mir-124; mir-148a; mir-29a; mir-375 |
| Colon/Colorectal | let-7a-1; let-7a-2; let-7a-3; let-7b; let-7c; let-7d; let-7e; let-7f-1; let-7f-2; let-7g; let-7i; mir-100; mir-101; mir-126; mir-142-3p; mir-143; mir-145; mir-192; mir-200c; mir-21; mir-214; mir-215; mir-22; mir-25; mir-302a; mir-320; mir-320a; mir-34a; mir-34c; mir-365; mir-373; mir-424; mir-429; mir-455; mir-484; mir-502; mir-503; mir-93; mir-98; mir-186; mir-30a-5p; mir-627; let-7a; mir-1; mir-124; mir-125a; mir-129; mir-1295b-3p; mir-1307; mir-130b; mir-132; mir- |

TABLE 8-continued

Tumor suppresor miRs that are downregulated in specific cancer types

| Cancer | miRNA |
|---|---|
| | 133a; mir-133b; mir-137; mir-138; mir-139; mir-139-5p; mir-140-5p; mir-148a; mir-148b; mir-149; mir-150-5p; mir-154; mir-15a; mir-15b; mir-16; mir-18a; mir-191; mir-193a-5p; mir-194; mir-195; mir-196a; mir-198; mir-199a-5p; mir-203; mir-204-5p; mir-206; mir-212; mir-218; mir-224; mir-24-3p; mir-26b; mir-27a; mir-28-3p; mir-28-5p; mir-29b; mir-30a-3p; mir-30b; mir-328; mir-338-3p; mir-342; mir-345; mir-34a-5p; mir-361-5p; mir-375; mir-378; mir-378a-3p; mir-378a-5p; mir-409-3p; mir-422a; mir-4487; mir-483; mir-497; mir-498; mir-518a-3p; mir-551a; mir-574-5p; mir-625; mir-638; mir-7; mir-96-5p; mir-202-3p; mir-30a; mir-451 |
| Endometrial | mir-101; mir-130a; mir-130b; mir-134; mir-143; mir-145; mir-152; mir-205; mir-223; mir-301a; mir-301b; mir-30c; mir-34a; mir-34c; mir-424; mir-449a; mir-543; mir-34b |
| Hematologic (Leukemia, Lymphoma, Myeloma) | mir-125b; mir-138; mir-15a; mir-15b; mir-16; mir-16-1; mir-16-1-3p; mir-16-2; mir-181a; mir-181b; mir-195; mir-223; mir-29b; mir-34b; mir-34c; mir-424; mir-10a; mir-146a; mir-150; mir-151; mir-155; mir-2278; mir-26a; mir-30e; mir-31; mir-326; mir-564; mir-27a; let-7b; mir-124a; mir-142-3p; let-7c; mir-17; mir-20a; mir-29a; mir-30c; mir-720; mir-107; mir-342; mir-34a; mir-202; mir-142-5p; mir-29c; mir-145; mir-193b; mir-199a; mir-214; mir-22; mir-137; mir-197 |
| Kidney | mir-1; mir-145; mir-1826; mir-199a; mir-199a-3p; mir-203; mir-205; mir-497; mir-508-3p; mir-509-3p; let-7a; let-7d; mir-106a*; mir-126; mir-1285; mir-129-3p; mir-1291; mir-133a; mir-135a; mir-138; mir-141; mir-143; mir-182-5p; mir-200a; mir-218; mir-28-5p; mir-30a; mir-30c; mir-30d; mir-34a; mir-378; mir-429; mir-509-5p; mir-646; mir-133b; let-7b; let-7c; mir-200c; mir-204; mir-335; mir-377; mir-506 |
| Liver (Hepatocellular Carcinoma) | mir-137; mir-138; mir-139; mir-139-5p; mir-140-5p; mir-141; mir-142-3p; mir-143; mir-144; mir-145; mir-146a; mir-148a; mir-148b; mir-150-5p; mir-15b; mir-16; mir-181a-5p; mir-185; mir-188-5p; mir-193b; mir-195; mir-195-5p; mir-197; mir-198; mir-199a; mir-199a-5p; mir-199b; mir-199b-5p; mir-200a; mir-200b; mir-200c; mir-202; mir-203; mir-204-3p; mir-205; mir-206; mir-20a; mir-21; mir-21-3p; mir-211; mir-212; mir-214; mir-217; mir-218; mir-219-5p; mir-22; mir-223; mir-26a; mir-26b; mir-29a; mir-29b-1; mir-29b-2; mir-29c; mir-302b; mir-302c; mir-30a; mir-30a-3p; mir-335; mir-338-3p; mir-33a; mir-34a; mir-34b; mir-365; mir-370; mir-372; mir-375; mir-376a; mir-377; mir-422a; mir-424; mir-424-5p; mir-433; mir-4458; mir-448; mir-450a; mir-451; mir-485-5p; mir-486-5p; mir-497; mir-503; mir-506; mir-519d; mir-520a; mir-520b; mir-520c-3p; mir-582-5p; mir-590-5p; mir-610; mir-612; mir-625; mir-637; mir-675; mir-7; mir-877; mir-940; mir-941; mir-98; mir-99a; mir-132; mir-31 |
| Lung | mir-1297; mir-141; mir-145; mir-16; mir-200a; mir-200b; mir-200c; mir-29b; mir-381; mir-409-3p; mir-429; mir-451; mir-511; mir-99a; let-7a-1; let-7a-2; let-7a-3; let-7b; let-7c; let-7d; let-7e; let-7f-1; let-7f-2; let-7g; let-7i; mir-1; mir-101; mir-133b; mir-138; mir-142-5p; mir-144; mir-1469; mir-146a; mir-153; mir-15a; mir-15b; mir-16-1; mir-16-2; mir-182; mir-192; mir-193a-3p; mir-194; mir-195; mir-198; mir-203; mir-217; mir-218; mir-22; mir-223; mir-26a; mir-26b; mir-29c; mir-33a; mir-34a; mir-34b; mir-34c; mir-365; mir-449a; mir-449b; mir-486-5p; mir-545; mir-610; mir-614; mir-630; mir-660; mir-7515; mir-9500; mir-98; mir-99b; mir-133a; let-7a; mir-100; mir-106a; mir-107; mir-124; mir-125a-3p; mir-125a-5p; mir-126; mir-126*; mir-129; mir-137; mir-140; mir-143; mir-146b; mir-148a; mir-148b; mir-149; mir-152; mir-154; mir-155; mir-17-5p; mir-181a-1; mir-181a-2; mir-181b; mir-181b-1; mir-181b-2; mir-181c; mir-181d; mir-184; mir-186; mir-193b; mir-199a; mir-204; mir-212; mir-221; mir-224; mir-27a; mir-27b; mir-29a; mir-30a; mir-30b; mir-30c; mir-30d; mir-30d-5p; mir-30e-5p; mir-32; mir-335; mir-338-3p; mir-340; mir-342-3p; mir-361-3p; mir-373; mir-375; mir-4500; mir-4782-3p; mir-497; mir-503; mir-512-3p; mir-520a-3p; mir-526b; mir-625*; mir-96 |
| Melanoma | let-7b; mir-101; mir-125b; mir-1280; mir-143; mir-146a; mir-146b; mir-155; mir-17; mir-184; mir-185; mir-18b; mir-193b; mir-200c; mir-203; mir-204; mir-205; mir-206; mir-20a; mir-211; mir-218; mir-26a; mir-31; mir-33a; mir-34a; mir-34c; mir-376a; mir-376c; mir-573; mir-7-5p; mir-9; mir-98 |
| Oral Cancer | let-7d; mir-218; mir-34a; mir-375; mir-494; mir-100; mir-124; mir-1250; mir-125b; mir-126; mir-1271; mir-136; mir-138; mir-145; mir-147; mir-148a; mir-181a; mir-206; mir-220a; mir-26a; mir-26b; mir-29a; mir-32; mir-323-5p; mir-329; mir-338; mir-370; mir-410; mir-429; mir-433; mir-499a-5p; mir-503; mir-506; mir-632; mir-646; mir-668; mir-877; mir-9 |
| Ovarian | let-7i; mir-100; mir-124; mir-125b; mir-129-5p; mir-130b; mir-133a; mir-137; mir-138; mir-141; mir-145; mir-148a; mir-152; mir-153; mir-155; mir-199a; mir-200a; mir-200b; mir-200c; mir-212; mir-335; mir-34a; mir-34b; mir-34c; mir-409-3p; mir-411; mir-429; mir-432; mir-449a; mir-494; mir-497; mir-498; mir-519d; mir-655; mir-9; mir-98; mir-101; mir-532-5p; mir-124a; mir-192; mir-193a; mir-7 |
| Pancreatic | mir-101; mir-1181; mir-124; mir-1247; mir-133a; mir-141; mir-145; mir-146a; mir-148a; mir-148b; mir-150*; mir-150-5p; mir-152; mir-15a; mir-198; mir-203; mir-214; mir-216a; mir-29c; mir-335; mir-34a; mir-34b; mir-34c; mir-373; mir-375; mir-410; mir-497; mir-615-5p; mir-630; mir-96; mir-132; let-7a; let-7a-1; let-7a-2; let-7a-3; let-7b; let-7c; let-7d; let-7e; let-7f-1; let-7f-2; let-7g; |

TABLE 8-continued

Tumor suppresor miRs that are downregulated in specific cancer types

| Cancer | miRNA |
| --- | --- |
|  | let-7i; mir-126; mir-135a; mir-143; mir-144; mir-150; mir-16; mir-200a; mir-200b; mir-200c; mir-217; mir-218; mir-337; mir-494; mir-98 |
| Prostate | let-7a-3p; let-7c; mir-100; mir-101; mir-105; mir-124; mir-128; mir-1296; mir-130b; mir-133a-1; mir-133a-2; mir-133b; mir-135a; mir-143; mir-145; mir-146a; mir-154; mir-15a; mir-187; mir-188-5p; mir-199b; mir-200b; mir-203; mir-205; mir-212; mir-218; mir-221; mir-224; mir-23a; mir-23b; mir-25; mir-26a; mir-26b; mir-29b; mir-302a; mir-30a; mir-30b; mir-30c-1; mir-30c-2; mir-30d; mir-30e; mir-31; mir-330; mir-331-3p; mir-34a; mir-34b; mir-34c; mir-374b; mir-449a; mir-4723-5p; mir-497; mir-628-5p; mir-642a-5p; mir-765; mir-940 |
| Retinoblastoma | mir-101; mir-183; mir-204; mir-34a; mir-365b-3p; mir-486-3p; mir-532-5p |

SEQUENCE LISTING (855 sequences)

SEQ ID NO: 1 - RNA, 22 nt, Homo sapiens
  source 1..22: mol_type = other RNA
tggagtgtgacaatggtgtttg

SEQ ID NO: 2 - RNA, 20 nt, Homo sapiens
  source 1..20: mol_type = other RNA
taaggcacgcggtgaatgcc

SEQ ID NO: 3 - RNA, 24 nt, Homo sapiens
  source 1..24: mol_type = other RNA
tccctgagaccctttaacctgtga

SEQ ID NO: 4 - RNA, 22 nt, Homo sapiens
  source 1..22: mol_type = other RNA
tcgtaccgtgagtaataatgcg

SEQ ID NO: 5 - RNA, 22 nt, Homo sapiens
  source 1..22: mol_type = other RNA
tcggatccgtctgagcttggct

SEQ ID NO: 6 - RNA, 21 nt, Homo sapiens
  source 1..21: mol_type = other RNA
tcacagtgaaccggtctcttt

SEQ ID NO: 7 - RNA, 22 nt, Homo sapiens
  source 1..22: mol_type = other RNA
aagcccttaccccaaaaagtat

SEQ ID NO: 8 - RNA, 21 nt, Homo sapiens
  source 1..21: mol_type = other RNA
ctttttgcggtctgggcttgc

SEQ ID NO: 9 - RNA, 22 nt, Homo sapiens
  source 1..22: mol_type = other RNA
cagtgcaatgatgaaagggcat

SEQ ID NO: 10 - RNA, 21 nt, Homo sapiens
  source 1..21: mol_type = other RNA
actctttccctgttgcactac

SEQ ID NO: 11 - RNA, 22 nt, Homo sapiens
  source 1..22: mol_type = other RNA
tttggtccccttcaaccagctg

SEQ ID NO: 12 - RNA, 22 nt, Homo sapiens
  source 1..22: mol_type = other RNA
tttggtccccttcaaccagcta

SEQ ID NO: 13 - RNA, 23 nt, Homo sapiens
  source 1..23: mol_type = other RNA
cctgtgggccacctagtcaccaa

SEQ ID NO: 14 - RNA, 23 nt, Homo sapiens
  source 1..23: mol_type = other RNA
ttattgcttaagaatacgcgtag

SEQ ID NO: 15 - RNA, 22 nt, Homo sapiens
  source 1..22: mol_type = other RNA
tggaatgtaaagaagtatgtat

SEQ ID NO: 16 - RNA, 21 nt, Homo sapiens
  source 1..21: mol_type = other RNA
tgagatgaagcactgtagctc

SEQ ID NO: 17 - RNA, 22 nt, Homo sapiens
  source 1..22: mol_type = other RNA
ggattcctggaaatactgttct

SEQ ID NO: 18 - RNA, 23 nt, Homo sapiens
  source 1..23: mol_type = other RNA
gtccagttttcccaggaatccct

SEQ ID NO: 19 - RNA, 22 nt, Homo sapiens
  source 1..22: mol_type = other RNA
tggacggagaactgataagggt

SEQ ID NO: 20 - RNA, 22 nt, Homo sapiens
  source 1..22: mol_type = other RNA
acagtagtctgcacattggtta

SEQ ID NO: 21 - RNA, 23 nt, Homo sapiens
  source 1..23: mol_type = other RNA
cccagtgttcagactacctgttc

SEQ ID NO: 22 - RNA, 22 nt, Homo sapiens
  source 1..22: mol_type = other RNA
ttccctttgtcatcctatgcct

SEQ ID NO: 23 - RNA, 22 nt, Homo sapiens
  source 1..22: mol_type = other RNA
ataagacgaacaaaaggtttgt

SEQ ID NO: 24 - RNA, 22 nt, Homo sapiens
  source 1..22: mol_type = other RNA
acagcaggcacagacaggcagt

SEQ ID NO: 25 - RNA, 23 nt, Homo sapiens
  source 1..23: mol_type = other RNA
tactgcatcaggaactgattgga

SEQ ID NO: 26 - RNA, 21 nt, Homo sapiens
  source 1..21: mol_type = other RNA
tgattgtccaaacgcaattct

SEQ ID NO: 27 - RNA, 22 nt, Homo sapiens
  source 1..22: mol_type = other RNA
tgtcagtttgtcaaatacccca

SEQ ID NO: 28 - RNA, 22 nt, Homo sapiens
  source 1..22: mol_type = other RNA
tggcagtgtcttagctggttgt

SEQ ID NO: 29 - RNA, 22 nt, Homo sapiens
  source 1..22: mol_type = other RNA
aaaccgttaccattactgagtt

SEQ ID NO: 30 - RNA, 21 nt, Homo sapiens
  source 1..21: mol_type = other RNA
taaagtaaatatgcaccaaaa

SEQ ID NO: 31 - RNA, 22 nt, Homo sapiens
  source 1..22: mol_type = other RNA
tgaggtagtaggttgtatagtt

SEQ ID NO: 32 - RNA, 23 nt, Homo sapiens
  source 1..23: mol_type = other RNA
tctttggttatctagctgtatga

SEQ ID NO: 33 - RNA, 22 nt, Homo sapiens
  source 1..22: mol_type = other RNA
tgaggtagtaggttgtgtggtt

SEQ ID NO: 34 - RNA, 22 nt, Homo sapiens
  source 1..22: mol_type = other RNA
tgaggtagtaggttgtatggtt

SEQ ID NO: 35 - RNA, 22 nt, Homo sapiens
  source 1..22: mol_type = other RNA
agaggtagtaggttgcatagtt

SEQ ID NO: 36 - RNA, 22 nt, Homo sapiens
  source 1..22: mol_type = other RNA
tgaggtaggaggttgtatagtt

SEQ ID NO: 37 - RNA, 22 nt, Homo sapiens
  source 1..22: mol_type = other RNA
tgaggtagtagattgtatagtt

SEQ ID NO: 38 - RNA, 22 nt, Homo sapiens
  source 1..22: mol_type = other RNA
tgaggtagtagtttgtacagtt

SEQ ID NO: 39 - RNA, 22 nt, Homo sapiens
  source 1..22: mol_type = other RNA
tgaggtagtagtttgtgctgtt

SEQ ID NO: 40 - RNA, 22 nt, Homo sapiens
  source 1..22: mol_type = other RNA
aacccgtagatccgaacttgtg

SEQ ID NO: 41 - RNA, 21 nt, Homo sapiens
  source 1..21: mol_type = other RNA
tacagtactgtgataactgaa

SEQ ID NO: 42 - RNA, 23 nt, Homo sapiens
  source 1..23: mol_type = other RNA
agcagcattgtacagggctatga

SEQ ID NO: 43 - RNA, 23 nt, Homo sapiens
  source 1..23: mol_type = other RNA
tcaaatgctcagactcctgtggt

SEQ ID NO: 44 - RNA, 23 nt, Homo sapiens
  source 1..23: mol_type = other RNA
aaaagtgcttacagtgcaggtag

SEQ ID NO: 45 - RNA, 21 nt, Homo sapiens
  source 1..21: mol_type = other RNA
taaagtgctgacagtgcagat

SEQ ID NO: 46 - RNA, 23 nt, Homo sapiens
  source 1..23: mol_type = other RNA
agcagcattgtacagggctatca

SEQ ID NO: 47 - RNA, 23 nt, Homo sapiens
  source 1..23: mol_type = other RNA
taccctgtagatccgaatttgtg

SEQ ID NO: 48 - RNA, 23 nt, Homo sapiens
  source 1..23: mol_type = other RNA
taccctgtagaaccgaatttgtg

SEQ ID NO: 49 - RNA, 21 nt, Homo sapiens
  source 1..21: mol_type = other RNA
ttgctcactgttcttccctag

SEQ ID NO: 50 - RNA, 22 nt, Homo sapiens
  source 1..22: mol_type = other RNA
tttccggctcgcgtgggtgtgt

SEQ ID NO: 51 - RNA, 27 nt, Homo sapiens
  source 1..27: mol_type = other RNA
cactgtaggtgatggtgagagtgggca

SEQ ID NO: 52 - RNA, 22 nt, Homo sapiens
  source 1..22: mol_type = other RNA
atatacagggggagactcttat

SEQ ID NO: 53 - RNA, 22 nt, Homo sapiens
  source 1..22: mol_type = other RNA
atatacagggggagactctcat

SEQ ID NO: 54 - RNA, 21 nt, Homo sapiens
  source 1..21: mol_type = other RNA
agaggataccctttgtatgtt

SEQ ID NO: 55 - RNA, 23 nt, Homo sapiens
  source 1..23: mol_type = other RNA
gggatggtagaccggtgacgtgc

SEQ ID NO: 56 - RNA, 21 nt, Homo sapiens
  source 1..21: mol_type = other RNA
taggacacatggtctacttct

SEQ ID NO: 57 - RNA, 22 nt, Homo sapiens
  source 1..22: mol_type = other RNA
ctcctgagccattctgagcctc

SEQ ID NO: 58 - RNA, 21 nt, Homo sapiens
  source 1..21: mol_type = other RNA
gtgccagctgcagtgggggag

SEQ ID NO: 59 - RNA, 21 nt, Homo sapiens
  source 1..21: mol_type = other RNA
cccggagccaggatgcagctc

SEQ ID NO: 60 - RNA, 21 nt, Homo sapiens
  source 1..21: mol_type = other RNA
tcgtggcctggtctccattat

SEQ ID NO: 61 - RNA, 20 nt, Homo sapiens
  source 1..20: mol_type = other RNA
tctgcagggtttgctttgag

SEQ ID NO: 62 - RNA, 21 nt, Homo sapiens
  source 1..21: mol_type = other RNA
tgttcatgtagatgtttaagc

SEQ ID NO: 63 - RNA, 21 nt, Homo sapiens
  source 1..21: mol_type = other RNA
ccccacctcctctctcctcag

SEQ ID NO: 64 - RNA, 19 nt, Homo sapiens
  source 1..19: mol_type = other RNA
gtgaggactcgggaggtgg

SEQ ID NO: 65 - RNA, 22 nt, Homo sapiens
  source 1..22: mol_type = other RNA
tcaccagccctgtgttccctag

SEQ ID NO: 66 - RNA, 20 nt, Homo sapiens
  source 1..20: mol_type = other RNA
tcacacctgcctcgcccccc

SEQ ID NO: 67 - RNA, 20 nt, Homo sapiens
  source 1..20: mol_type = other RNA
tgagccctgtcctcccgcag

SEQ ID NO: 68 - RNA, 22 nt, Homo sapiens
  source 1..22: mol_type = other RNA
tcggcctgaccacccaccccac

SEQ ID NO: 69 - RNA, 22 nt, Homo sapiens
  source 1..22: mol_type = other RNA
cctcttccccttgtctctccag

SEQ ID NO: 70 - RNA, 26 nt, Homo sapiens
  source 1..26: mol_type = other RNA
aagtagttggtttgtatgagatggtt

SEQ ID NO: 71 - RNA, 21 nt, Homo sapiens
  source 1..21: mol_type = other RNA
aagtgatctaaaggcctacat

SEQ ID NO: 72 - RNA, 22 nt, Homo sapiens
  source 1..22: mol_type = other RNA
tcagatgatctaaaggcctata

SEQ ID NO: 73 - RNA, 21 nt, Homo sapiens
  source 1..21: mol_type = other RNA
taggcctttagatcacttaaa

SEQ ID NO: 74 - RNA, 19 nt, Homo sapiens
  source 1..19: mol_type = other RNA
aatggatttttggagcagg

SEQ ID NO: 75 - RNA, 22 nt, Homo sapiens
  source 1..22: mol_type = other RNA
acccgtcccgttcgtccccgga

SEQ ID NO: 76 - RNA, 27 nt, Homo sapiens
  source 1..27: mol_type = other RNA
accttcttgtataagcactgtgctaaa

SEQ ID NO: 77 - RNA, 22 nt, Homo sapiens
  source 1..22: mol_type = other RNA
acgcccttcccccccttcttca

SEQ ID NO: 78 - RNA, 24 nt, Homo sapiens
  source 1..24: mol_type = other RNA
aggagggaggagatgggccaagtt

SEQ ID NO: 79 - RNA, 21 nt, Homo sapiens
  source 1..21: mol_type = other RNA
acggtgctggatgtggccttt

SEQ ID NO: 80 - RNA, 22 nt, Homo sapiens
  source 1..22: mol_type = other RNA
agaaggaaattgaattcattta

SEQ ID NO: 81 - RNA, 21 nt, Homo sapiens
  source 1..21: mol_type = other RNA
agagaagaagatcagcctgca

SEQ ID NO: 82 - RNA, 24 nt, Homo sapiens
  source 1..24: mol_type = other RNA
agcctggaagctggagcctgcagt

SEQ ID NO: 83 - RNA, 23 nt, Homo sapiens
  source 1..23: mol_type = other RNA
aggatgagcaaagaaagtagatt

SEQ ID NO: 84 - RNA, 22 nt, Homo sapiens
  source 1..22: mol_type = other RNA
cggatgagcaaagaaagtggtt

SEQ ID NO: 85 - RNA, 21 nt, Homo sapiens
  source 1..21: mol_type = other RNA
agtgaatgatgggttctgacc

SEQ ID NO: 86 - RNA, 21 nt, Homo sapiens
  source 1..21: mol_type = other RNA
agttaggattaggtcgtggaa

SEQ ID NO: 87 - RNA, 22 nt, Homo sapiens
  source 1..22: mol_type = other RNA
acaggtgaggttcttgggagcc

SEQ ID NO: 88 - RNA, 22 nt, Homo sapiens
  source 1..22: mol_type = other RNA
tccctgagaccctaacttgtga

SEQ ID NO: 89 - RNA, 18 nt, Homo sapiens
  source 1..18: mol_type = other RNA
atcccacctctgccacca

SEQ ID NO: 90 - RNA, 19 nt, Homo sapiens
  source 1..19: mol_type = other RNA
atcccaccactgccaccat

SEQ ID NO: 91 - RNA, 19 nt, Homo sapiens
  source 1..19: mol_type = other RNA
atggataaggctttggctt

SEQ ID NO: 92 - RNA, 22 nt, Homo sapiens
  source 1..22: mol_type = other RNA
atgggtgaatttgtagaaggat

SEQ ID NO: 93 - RNA, 23 nt, Homo sapiens
  source 1..23: mol_type = other RNA
caagtcttatttgagcacctgtt

SEQ ID NO: 94 - RNA, 23 nt, Homo sapiens
  source 1..23: mol_type = other RNA
cctcagggctgtagaacagggct

SEQ ID NO: 95 - RNA, 18 nt, Homo sapiens
  source 1..18: mol_type = other RNA
cgggcgtggtggtggggg

SEQ ID NO: 96 - RNA, 20 nt, Homo sapiens
  source 1..20: mol_type = other RNA
cgggcgtggtggtgggggtg

SEQ ID NO: 97 - RNA, 22 nt, Homo sapiens
  source 1..22: mol_type = other RNA
ctggactgagccgtgctactgg

SEQ ID NO: 98 - RNA, 22 nt, Homo sapiens
  source 1..22: mol_type = other RNA
ctggactgagccatgctactgg

SEQ ID NO: 99 - RNA, 23 nt, Homo sapiens
  source 1..23: mol_type = other RNA
ctggagatatggaagagctgtgt

SEQ ID NO: 100 - RNA, 22 nt, Homo sapiens
  source 1..22: mol_type = other RNA
agtgcctgctatgtgccaggca

SEQ ID NO: 101 - RNA, 22 nt, Homo sapiens
  source 1..22: mol_type = other RNA
cttggcacctagcaagcactca

SEQ ID NO: 102 - RNA, 26 nt, Homo sapiens
  source 1..26: mol_type = other RNA
gatgatgatggcagcaaattctgaaa

SEQ ID NO: 103 - RNA, 22 nt, Homo sapiens
  source 1..22: mol_type = other RNA
ggcgacaaaacgagaccctgtc

SEQ ID NO: 104 - RNA, 17 nt, Homo sapiens
  source 1..17: mol_type = other RNA
gtgggggagaggctgtc

SEQ ID NO: 105 - RNA, 22 nt, Homo sapiens
  source 1..22: mol_type = other RNA
ctgaagctcagagggctctgat

SEQ ID NO: 106 - RNA, 20 nt, Homo sapiens
  source 1..20: mol_type = other RNA
taaagagccctgtggagaca

SEQ ID NO: 107 - RNA, 22 nt, Homo sapiens
  source 1..22: mol_type = other RNA
tacgtagatatatatgtatttt

SEQ ID NO: 108 - RNA, 22 nt, Homo sapiens
  source 1..22: mol_type = other RNA
tagtactgtgcatatcatctat

SEQ ID NO: 109 - RNA, 17 nt, Homo sapiens
  source 1..17: mol_type = other RNA
tcatattgcttctttct

SEQ ID NO: 110 - RNA, 17 nt, Homo sapiens
  source 1..17: mol_type = other RNA
tcgcctcctcctctccc

SEQ ID NO: 111 - RNA, 23 nt, Homo sapiens
  source 1..23: mol_type = other RNA
cggggccgtagcactgtctgaga

SEQ ID NO: 112 - RNA, 23 nt, Homo sapiens
  source 1..23: mol_type = other RNA
gggggccgatacactgtacgaga

SEQ ID NO: 113 - RNA, 22 nt, Homo sapiens
  source 1..22: mol_type = other RNA
tctacaaaggaaagcgctttct

SEQ ID NO: 114 - RNA, 22 nt, Homo sapiens
  source 1..22: mol_type = other RNA
tctgggcaacaaagtgagacct

SEQ ID NO: 115 - RNA, 21 nt, Homo sapiens
  source 1..21: mol_type = other RNA
gatctcactttgttgcccagg

SEQ ID NO: 116 - RNA, 21 nt, Homo sapiens
  source 1..21: mol_type = other RNA
tgcaggaccaagatgagccct

SEQ ID NO: 117 - RNA, 22 nt, Homo sapiens
  source 1..22: mol_type = other RNA
ctctagccacagatgcagtgat

SEQ ID NO: 118 - RNA, 22 nt, Homo sapiens
  source 1..22: mol_type = other RNA
tgctggatcagtggttcgagtc

SEQ ID NO: 119 - RNA, 21 nt, Homo sapiens
  source 1..21: mol_type = other RNA
tggactgccctgatctggaga

SEQ ID NO: 120 - RNA, 23 nt, Homo sapiens
  source 1..23: mol_type = other RNA
tggagtccaggaatctgcatttt

SEQ ID NO: 121 - RNA, 19 nt, Homo sapiens
  source 1..19: mol_type = other RNA
tggatttttggatcaggga

SEQ ID NO: 122 - RNA, 24 nt, Homo sapiens
  source 1..24: mol_type = other RNA
tggccctgactgaagaccagcagt

SEQ ID NO: 123 - RNA, 22 nt, Homo sapiens
  source 1..22: mol_type = other RNA
aagcccttaccccaaaaagcat

SEQ ID NO: 124 - RNA, 22 nt, Homo sapiens
  source 1..22: mol_type = other RNA
tgggtggtctggagatttgtgc

SEQ ID NO: 125 - RNA, 21 nt, Homo sapiens
  source 1..21: mol_type = other RNA
ttaggccgcagatctgggtga

SEQ ID NO: 126 - RNA, 22 nt, Homo sapiens
  source 1..22: mol_type = other RNA
gagtggggcttcgaccctaacc

SEQ ID NO: 127 - RNA, 22 nt, Homo sapiens
  source 1..22: mol_type = other RNA
ttagggccctggctccatctcc

SEQ ID NO: 128 - RNA, 17 nt, Homo sapiens
  source 1..17: mol_type = other RNA
ttcaagtaattcaggtg

SEQ ID NO: 129 - RNA, 22 nt, Homo sapiens
  source 1..22: mol_type = other RNA
ttcattcggctgtccagatgta

SEQ ID NO: 130 - RNA, 22 nt, Homo sapiens
  source 1..22: mol_type = other RNA
ttctggaattctgtgtgaggga

SEQ ID NO: 131 - RNA, 24 nt, Homo sapiens
  source 1..24: mol_type = other RNA
ttgcagctgcctgggagtgacttc

SEQ ID NO: 132 - RNA, 21 nt, Homo sapiens
  source 1..21: mol_type = other RNA
ttgggacatacttatgctaaa

SEQ ID NO: 133 - RNA, 22 nt, Homo sapiens
  source 1..22: mol_type = other RNA
tttagagacggggtcttgctct

SEQ ID NO: 134 - RNA, 22 nt, Homo sapiens
  source 1..22: mol_type = other RNA
tctcactgtagcctcgaacccc

SEQ ID NO: 135 - RNA, 22 nt, Homo sapiens
  source 1..22: mol_type = other RNA
tttgaggctacagtgagatgtg

SEQ ID NO: 136 - RNA, 22 nt, Homo sapiens
  source 1..22: mol_type = other RNA
ttttcaactctaatgggagaga

SEQ ID NO: 137 - RNA, 18 nt, Homo sapiens
  source 1..18: mol_type = other RNA
acgttggctctggtggtg

SEQ ID NO: 138 - RNA, 22 nt, Homo sapiens
  source 1..22: mol_type = other RNA
ccacctcccctgcaaacgtcca

SEQ ID NO: 139 - RNA, 22 nt, Homo sapiens
  source 1..22: mol_type = other RNA
actcggcgtggcgtcggtcgtg

SEQ ID NO: 140 - RNA, 21 nt, Homo sapiens
  source 1..21: mol_type = other RNA
tcgaccggacctcgaccggct

SEQ ID NO: 141 - RNA, 22 nt, Homo sapiens
  source 1..22: mol_type = other RNA
cagtgcaatgttaaaagggcat

SEQ ID NO: 142 - RNA, 22 nt, Homo sapiens
  source 1..22: mol_type = other RNA
cagtgcaatgatgaaagggcat

SEQ ID NO: 143 - RNA, 19 nt, Homo sapiens
  source 1..19: mol_type = other RNA
gatgatgctgctgatgctg

SEQ ID NO: 144 - RNA, 22 nt, Homo sapiens
  source 1..22: mol_type = other RNA
tcaaaactgaggggcattttct

SEQ ID NO: 145 - RNA, 22 nt, Homo sapiens
  source 1..22: mol_type = other RNA
taacagtctacagccatggtcg

SEQ ID NO: 146 - RNA, 22 nt, Homo sapiens
  source 1..22: mol_type = other RNA
agctggtaaaatggaaccaaat

SEQ ID NO: 147 - RNA, 22 nt, Homo sapiens
  source 1..22: mol_type = other RNA
tgtgactggttgaccagagggg

SEQ ID NO: 148 - RNA, 23 nt, Homo sapiens
  source 1..23: mol_type = other RNA
tatggctttttattcctatgtga

SEQ ID NO: 149 - RNA, 23 nt, Homo sapiens
  source 1..23: mol_type = other RNA
tatggcttttcattcctatgtga

SEQ ID NO: 150 - RNA, 23 nt, Homo sapiens
  source 1..23: mol_type = other RNA
actccatttgttttgatgatgga

SEQ ID NO: 151 - RNA, 23 nt, Homo sapiens
  source 1..23: mol_type = other RNA
agctggtgttgtgaatcaggccg

SEQ ID NO: 152 - RNA, 23 nt, Homo sapiens
  source 1..23: mol_type = other RNA
tggagacgcggccctgttggagt

SEQ ID NO: 153 - RNA, 23 nt, Homo sapiens
  source 1..23: mol_type = other RNA
tctacagtgcacgtgtctccagt

SEQ ID NO: 154 - RNA, 21 nt, Homo sapiens
  source 1..21: mol_type = other RNA
taccacagggtagaaccacgg

SEQ ID NO: 155 - RNA, 22 nt, Homo sapiens
  source 1..22: mol_type = other RNA
cagtggttttaccctatggtag

SEQ ID NO: 156 - RNA, 22 nt, Homo sapiens
  source 1..22: mol_type = other RNA
taacactgtctggtaaagatgg

SEQ ID NO: 157 - RNA, 23 nt, Homo sapiens
  source 1..23: mol_type = other RNA
tgtagtgtttcctactttatgga

SEQ ID NO: 158 - RNA, 21 nt, Homo sapiens
  source 1..21: mol_type = other RNA
cataaagtagaaagcactact

SEQ ID NO: 159 - RNA, 20 nt, Homo sapiens
  source 1..20: mol_type = other RNA
tacagtatagatgatgtact

SEQ ID NO: 160 - RNA, 22 nt, Homo sapiens
  source 1..22: mol_type = other RNA
ctcggcgcggggcgcgggctcc

SEQ ID NO: 161 - RNA, 22 nt, Homo sapiens
  source 1..22: mol_type = other RNA
tgagaactgaattccatgggtt

SEQ ID NO: 162 - RNA, 22 nt, Homo sapiens
  source 1..22: mol_type = other RNA
tgccctgtggactcagttctgg

SEQ ID NO: 163 - RNA, 22 nt, Homo sapiens
  source 1..22: mol_type = other RNA
tgagaactgaattccataggct

SEQ ID NO: 164 - RNA, 20 nt, Homo sapiens
  source 1..20: mol_type = other RNA
gtgtgtggaaatgcttctgc

SEQ ID NO: 165 - RNA, 22 nt, Homo sapiens
  source 1..22: mol_type = other RNA
gtgtgcggaaatgcttctgcta

SEQ ID NO: 166 - RNA, 22 nt, Homo sapiens
  source 1..22: mol_type = other RNA
tcagtgcactacagaactttgt

SEQ ID NO: 167 - RNA, 22 nt, Homo sapiens
  source 1..22: mol_type = other RNA
tcagtgcatcacagaactttgt

SEQ ID NO: 168 - RNA, 23 nt, Homo sapiens
  source 1..23: mol_type = other RNA
tctggctccgtgtcttcactccc

SEQ ID NO: 169 - RNA, 22 nt, Homo sapiens
  source 1..22: mol_type = other RNA
tctcccaacccttgtaccagtg

SEQ ID NO: 170 - RNA, 21 nt, Homo sapiens
  source 1..21: mol_type = other RNA
ctagactgaagctccttgagg

SEQ ID NO: 171 - RNA, 21 nt, Homo sapiens
  source 1..21: mol_type = other RNA
tcgaggagctcacagtctagt

SEQ ID NO: 172 - RNA, 18 nt, Homo sapiens
  source 1..18: mol_type = other RNA
tcgaggagctcacagtct

SEQ ID NO: 173 - RNA, 21 nt, Homo sapiens
  source 1..21: mol_type = other RNA
tcagtgcatgacagaacttgg

SEQ ID NO: 174 - RNA, 23 nt, Homo sapiens
  source 1..23: mol_type = other RNA
aggttctgtgatacactccgact

SEQ ID NO: 175 - RNA, 22 nt, Homo sapiens
  source 1..22: mol_type = other RNA
ttgcatagtcacaaaagtgatc

SEQ ID NO: 176 - RNA, 22 nt, Homo sapiens
  source 1..22: mol_type = other RNA
aaaaccgtctagttacagttgt

SEQ ID NO: 177 - RNA, 22 nt, Homo sapiens
  source 1..22: mol_type = other RNA
taggttatccgtgttgccttcg

SEQ ID NO: 178 - RNA, 23 nt, Homo sapiens
  source 1..23: mol_type = other RNA
ttaatgctaatcgtgataggggt

SEQ ID NO: 179 - RNA, 22 nt, Homo sapiens
  source 1..22: mol_type = other RNA
tagcagcacataatggtttgtg

SEQ ID NO: 180 - RNA, 22 nt, Homo sapiens
  source 1..22: mol_type = other RNA
tagcagcacatcatggtttaca

SEQ ID NO: 181 - RNA, 22 nt, Homo sapiens
  source 1..22: mol_type = other RNA
acatacttctttatatgcccat

SEQ ID NO: 182 - RNA, 22 nt, Homo sapiens
  source 1..22: mol_type = other RNA
tagcagcacgtaaatattggcg

SEQ ID NO: 183 - RNA, 22 nt, Homo sapiens
  source 1..22: mol_type = other RNA
accactgaccgttgactgtacc

SEQ ID NO: 184 - RNA, 22 nt, Homo sapiens
  source 1..22: mol_type = other RNA
accatcgaccgttgattgtacc

SEQ ID NO: 185 - RNA, 23 nt, Homo sapiens
  source 1..23: mol_type = other RNA
aacattcaacgctgtcggtgagt

SEQ ID NO: 186 - RNA, 20 nt, Homo sapiens
  source 1..20: mol_type = other RNA
ctcactgatcaatgaatgca

SEQ ID NO: 187 - RNA, 23 nt, Homo sapiens
  source 1..23: mol_type = other RNA
aacattcattgctgtcggtgggt

SEQ ID NO: 188 - RNA, 22 nt, Homo sapiens
  source 1..22: mol_type = other RNA
aacattcaacctgtcggtgagt

SEQ ID NO: 189 - RNA, 21 nt, Homo sapiens
  source 1..21: mol_type = other RNA
ccaccgggggatgaatgtcac

SEQ ID NO: 190 - RNA, 21 nt, Homo sapiens
  source 1..21: mol_type = other RNA
tggttctagacttgccaacta

SEQ ID NO: 191 - RNA, 24 nt, Homo sapiens
  source 1..24: mol_type = other RNA
tttggcaatggtagaactcacact

SEQ ID NO: 192 - RNA, 18 nt, Homo sapiens
  source 1..18: mol_type = other RNA
tgaggcagtagattgaat

SEQ ID NO: 193 - RNA, 22 nt, Homo sapiens
  source 1..22: mol_type = other RNA
tatggcactggtagaattcact

SEQ ID NO: 194 - RNA, 22 nt, Homo sapiens
  source 1..22: mol_type = other RNA
tggagagaaaggcagttcctga

SEQ ID NO: 195 - RNA, 22 nt, Homo sapiens
  source 1..22: mol_type = other RNA
caaagaattctccttttgggct

SEQ ID NO: 196 - RNA, 22 nt, Homo sapiens
  source 1..22: mol_type = other RNA
tcgtgtcttgtgttgcagccgg

SEQ ID NO: 197 - RNA, 21 nt, Homo sapiens
  source 1..21: mol_type = other RNA
ctcccacatgcagggtttgca

SEQ ID NO: 198 - RNA, 21 nt, Homo sapiens
  source 1..21: mol_type = other RNA
catcccttgcatggtggaggg

SEQ ID NO: 199 - RNA, 23 nt, Homo sapiens
  source 1..23: mol_type = other RNA
taaggtgcatctagtgcagatag

SEQ ID NO: 200 - RNA, 23 nt, Homo sapiens
  source 1..23: mol_type = other RNA
taaggtgcatctagtgcagttag

SEQ ID NO: 201 - RNA, 21 nt, Homo sapiens
  source 1..21: mol_type = other RNA
ccggccgccggctccgccccg

SEQ ID NO: 202 - RNA, 21 nt, Homo sapiens
  source 1..21: mol_type = other RNA
cggcggggacggcgattggtc

SEQ ID NO: 203 - RNA, 22 nt, Homo sapiens
  source 1..22: mol_type = other RNA
cgcaggggccgggtgctcaccg

SEQ ID NO: 204 - RNA, 21 nt, Homo sapiens
  source 1..21: mol_type = other RNA
ctatatatcaaacatattcct

SEQ ID NO: 205 - RNA, 22 nt, Homo sapiens
  source 1..22: mol_type = other RNA
tgatatgtttgatatattaggt

SEQ ID NO: 206 - RNA, 21 nt, Homo sapiens
  source 1..21: mol_type = other RNA
tgatatgtttgatattgggtt

SEQ ID NO: 207 - RNA, 20 nt, Homo sapiens
  source 1..20: mol_type = other RNA
gaggcagaagcaggatgaca

SEQ ID NO: 208 - RNA, 21 nt, Homo sapiens
  source 1..21: mol_type = other RNA
ccagtcctgtgcctgccgcct

SEQ ID NO: 209 - RNA, 20 nt, Homo sapiens
  source 1..20: mol_type = other RNA
ccccagggcgacgcggcggg

SEQ ID NO: 210 - RNA, 23 nt, Homo sapiens
  source 1..23: mol_type = other RNA
caacggaatcccaaaagcagctg

SEQ ID NO: 211 - RNA, 21 nt, Homo sapiens
  source 1..21: mol_type = other RNA
ctgacctatgaattgacagcc

SEQ ID NO: 212 - RNA, 22 nt, Homo sapiens
  source 1..22: mol_type = other RNA
aactggcctacaaagtcccagt

SEQ ID NO: 213 - RNA, 22 nt, Homo sapiens
  source 1..22: mol_type = other RNA
tgggtctttgcgggcgagatga

SEQ ID NO: 214 - RNA, 22 nt, Homo sapiens
  source 1..22: mol_type = other RNA
aactggccctcaaagtcccgct

SEQ ID NO: 215 - RNA, 22 nt, Homo sapiens
  source 1..22: mol_type = other RNA
tgtaacagcaactccatgtgga

SEQ ID NO: 216 - RNA, 21 nt, Homo sapiens
  source 1..21: mol_type = other RNA
tagcagcacagaaatattggc

SEQ ID NO: 217 - RNA, 22 nt, Homo sapiens
  source 1..22: mol_type = other RNA
cggcaacaagaaactgcctgag

SEQ ID NO: 218 - RNA, 22 nt, Homo sapiens
  source 1..22: mol_type = other RNA
taggtagtttcatgttgttggg

SEQ ID NO: 219 - RNA, 22 nt, Homo sapiens
  source 1..22: mol_type = other RNA
taggtagtttcctgttgttggg

SEQ ID NO: 220 - RNA, 22 nt, Homo sapiens
  source 1..22: mol_type = other RNA
tcaggccaggcacagtggctca

SEQ ID NO: 221 - RNA, 19 nt, Homo sapiens
  source 1..19: mol_type = other RNA
accgtgcaaaggtagcata

SEQ ID NO: 222 - RNA, 22 nt, Homo sapiens
  source 1..22: mol_type = other RNA
ttcaccaccttctccacccagc

SEQ ID NO: 223 - RNA, 23 nt, Homo sapiens
  source 1..23: mol_type = other RNA
cgggtagagagggcagtgggagg

SEQ ID NO: 224 - RNA, 20 nt, Homo sapiens
  source 1..20: mol_type = other RNA
cctcctgccctccttgctgt

SEQ ID NO: 225 - RNA, 22 nt, Homo sapiens
  source 1..22: mol_type = other RNA
ggtccagaggggagataggttc

SEQ ID NO: 226 - RNA, 23 nt, Homo sapiens
  source 1..23: mol_type = other RNA
cccagtgtttagactatctgttc

SEQ ID NO: 227 - RNA, 23 nt, Homo sapiens
  source 1..23: mol_type = other RNA
tgtgcaaatctatgcaaaactga

SEQ ID NO: 228 - RNA, 23 nt, Homo sapiens
  source 1..23: mol_type = other RNA
tgtgcaaatccatgcaaaactga

SEQ ID NO: 229 - RNA, 22 nt, Homo sapiens
  source 1..22: mol_type = other RNA
taacactgtctggtaacgatgt

SEQ ID NO: 230 - RNA, 22 nt, Homo sapiens
  source 1..22: mol_type = other RNA
taatactgcctggtaatgatga

SEQ ID NO: 231 - RNA, 23 nt, Homo sapiens
  source 1..23: mol_type = other RNA
taatactgccgggtaatgatgga

SEQ ID NO: 232 - RNA, 20 nt, Homo sapiens
  source 1..20: mol_type = other RNA
agaggtatagggcatgggaa

SEQ ID NO: 233 - RNA, 22 nt, Homo sapiens
  source 1..22: mol_type = other RNA
gtgaaatgtttaggaccactag

SEQ ID NO: 234 - RNA, 25 nt, Homo sapiens
  source 1..25: mol_type = other RNA
agtggttcttaacagttcaacagtt

SEQ ID NO: 235 - RNA, 23 nt, Homo sapiens
  source 1..23: mol_type = other RNA
gtgttaattaaacctctatttac

SEQ ID NO: 236 - RNA, 22 nt, Homo sapiens
  source 1..22: mol_type = other RNA
tccttcattccaccggagtctg

SEQ ID NO: 237 - RNA, 22 nt, Homo sapiens
  source 1..22: mol_type = other RNA
tggaatgtaaggaagtgtgtgg

SEQ ID NO: 238 - RNA, 22 nt, Homo sapiens
  source 1..22: mol_type = other RNA
ataagacgagcaaaaagcttgt

SEQ ID NO: 239 - RNA, 22 nt, Homo sapiens
  source 1..22: mol_type = other RNA
aagctttttgctcgaattatgt

SEQ ID NO: 240 - RNA, 23 nt, Homo sapiens
  source 1..23: mol_type = other RNA
taaagtgcttatagtgcaggtag

SEQ ID NO: 241 - RNA, 22 nt, Homo sapiens
  source 1..22: mol_type = other RNA
ctgtgcgtgtgacagcggctga

SEQ ID NO: 242 - RNA, 22 nt, Homo sapiens
  source 1..22: mol_type = other RNA
agcccctgcccaccgcacactg

SEQ ID NO: 243 - RNA, 22 nt, Homo sapiens
  source 1..22: mol_type = other RNA
ttggggaaacggccgctgagtg

SEQ ID NO: 244 - RNA, 21 nt, Homo sapiens
  source 1..21: mol_type = other RNA
atttgtgcttggctctgtcac

SEQ ID NO: 245 - RNA, 21 nt, Homo sapiens
  source 1..21: mol_type = other RNA
gcagggacagcaaaggggtgc

SEQ ID NO: 246 - RNA, 22 nt, Homo sapiens
  source 1..22: mol_type = other RNA
ttccctttgtcatccttcgcct

SEQ ID NO: 247 - RNA, 21 nt, Homo sapiens
  source 1..21: mol_type = other RNA
ggttcttagcataggaggtct

SEQ ID NO: 248 - RNA, 21 nt, Homo sapiens
  source 1..21: mol_type = other RNA
tgttctctttgccaaggacag

SEQ ID NO: 249 - RNA, 21 nt, Homo sapiens
  source 1..21: mol_type = other RNA
taacagtctccagtcacggcc

SEQ ID NO: 250 - RNA, 21 nt, Homo sapiens
  source 1..21: mol_type = other RNA
atgacctatgaattgacagac

SEQ ID NO: 251 - RNA, 22 nt, Homo sapiens
  source 1..22: mol_type = other RNA
tagcttatcagactgatgttga

SEQ ID NO: 252 - RNA, 22 nt, Homo sapiens
  source 1..22: mol_type = other RNA
taatctcagctggcaactgtga

SEQ ID NO: 253 - RNA, 22 nt, Homo sapiens
  source 1..22: mol_type = other RNA
aaatctctgcaggcaaatgtga

SEQ ID NO: 254 - RNA, 21 nt, Homo sapiens
  source 1..21: mol_type = other RNA
ttgtgcttgatctaaccatgt

SEQ ID NO: 255 - RNA, 22 nt, Homo sapiens
  source 1..22: mol_type = other RNA
agagttgagtctggacgtcccg

SEQ ID NO: 256 - RNA, 22 nt, Homo sapiens
  source 1..22: mol_type = other RNA
agaattgtggctggacatctgt

SEQ ID NO: 257 - RNA, 23 nt, Homo sapiens
  source 1..23: mol_type = other RNA
agaattgcgtttggacaatcagt

SEQ ID NO: 258 - RNA, 23 nt, Homo sapiens
  source 1..23: mol_type = other RNA
agctacattgtctgctgggtttc

SEQ ID NO: 259 - RNA, 22 nt, Homo sapiens
  source 1..22: mol_type = other RNA
acctggcatacaatgtagattt

SEQ ID NO: 260 - RNA, 21 nt, Homo sapiens
  source 1..21: mol_type = other RNA
agctacatctggctactgggt

SEQ ID NO: 261 - RNA, 22 nt, Homo sapiens
  source 1..22: mol_type = other RNA
aagctgccagttgaagaactgt

SEQ ID NO: 262 - RNA, 21 nt, Homo sapiens
  source 1..21: mol_type = other RNA
caagtcactagtggttccgtt

SEQ ID NO: 263 - RNA, 22 nt, Homo sapiens
  source 1..22: mol_type = other RNA
gagagcagtgtgtgttgcctgg

SEQ ID NO: 264 - RNA, 21 nt, Homo sapiens
  source 1..21: mol_type = other RNA
atcacattgccagggatttcc

SEQ ID NO: 265 - RNA, 21 nt, Homo sapiens
  source 1..21: mol_type = other RNA
atcacattgccagggattacc

SEQ ID NO: 266 - RNA, 22 nt, Homo sapiens
  source 1..22: mol_type = other RNA
atcacattgccagtgattaccc

SEQ ID NO: 267 - RNA, 22 nt, Homo sapiens
  source 1..22: mol_type = other RNA
tggctcagttcagcaggaacag

SEQ ID NO: 268 - RNA, 22 nt, Homo sapiens
  source 1..22: mol_type = other RNA
cattgcacttgtctcggtctga

SEQ ID NO: 269 - RNA, 21 nt, Homo sapiens
  source 1..21: mol_type = other RNA
aggcggagacttgggcaattg

SEQ ID NO: 270 - RNA, 23 nt, Homo sapiens
  source 1..23: mol_type = other RNA
caggcagtgactgttcagacgtc

SEQ ID NO: 271 - RNA, 22 nt, Homo sapiens
  source 1..22: mol_type = other RNA
ttcaagtaatccaggataggct

SEQ ID NO: 272 - RNA, 21 nt, Homo sapiens
  source 1..21: mol_type = other RNA
ttcaagtaattcaggataggt

SEQ ID NO: 273 - RNA, 21 nt, Homo sapiens
  source 1..21: mol_type = other RNA
ttcacagtggctaagttccgc

SEQ ID NO: 274 - RNA, 21 nt, Homo sapiens
  source 1..21: mol_type = other RNA
ttcacagtggctaagttctgc

SEQ ID NO: 275 - RNA, 22 nt, Homo sapiens
  source 1..22: mol_type = other RNA
cactagattgtgagctcctgga

SEQ ID NO: 276 - RNA, 22 nt, Homo sapiens
  source 1..22: mol_type = other RNA
aaggagctcacagtctattgag

SEQ ID NO: 277 - RNA, 22 nt, Homo sapiens
  source 1..22: mol_type = other RNA
gagggttgggtggaggctctcc

SEQ ID NO: 278 - RNA, 21 nt, Homo sapiens
  source 1..21: mol_type = other RNA
agggccccccctcaatcctgt

SEQ ID NO: 279 - RNA, 21 nt, Homo sapiens
  source 1..21: mol_type = other RNA
atgtatgtgtgcatgtgcatg

SEQ ID NO: 280 - RNA, 24 nt, Homo sapiens
  source 1..24: mol_type = other RNA
agcagaagcagggaggttctccca

SEQ ID NO: 281 - RNA, 22 nt, Homo sapiens
  source 1..22: mol_type = other RNA
tatgtgggatggtaaaccgctt

SEQ ID NO: 282 - RNA, 22 nt, Homo sapiens
  source 1..22: mol_type = other RNA
tggtttaccgtcccacatacat

SEQ ID NO: 283 - RNA, 22 nt, Homo sapiens
  source 1..22: mol_type = other RNA
tagcaccatctgaaatcggtta

SEQ ID NO: 284 - RNA, 23 nt, Homo sapiens
  source 1..23: mol_type = other RNA
tagcaccatttgaaatcagtgtt

SEQ ID NO: 285 - RNA, 22 nt, Homo sapiens
  source 1..22: mol_type = other RNA
tagcaccatttgaaatcggtta

SEQ ID NO: 286 - RNA, 22 nt, Homo sapiens
  source 1..22: mol_type = other RNA
tatacaagggcagactctctct

SEQ ID NO: 287 - RNA, 23 nt, Homo sapiens
  source 1..23: mol_type = other RNA
cagtgcaatagtattgtcaaagc

SEQ ID NO: 288 - RNA, 22 nt, Homo sapiens
  source 1..22: mol_type = other RNA
gctctgactttattgcactact

SEQ ID NO: 289 - RNA, 23 nt, Homo sapiens
  source 1..23: mol_type = other RNA
cagtgcaatgatattgtcaaagc

SEQ ID NO: 290 - RNA, 22 nt, Homo sapiens
  source 1..22: mol_type = other RNA
gctctgacgaggttgcactact

SEQ ID NO: 291 - RNA, 23 nt, Homo sapiens
  source 1..23: mol_type = other RNA
taagtgcttccatgttttggtga

SEQ ID NO: 292 - RNA, 23 nt, Homo sapiens
  source 1..23: mol_type = other RNA
acttaaacgtggatgtacttgct

SEQ ID NO: 293 - RNA, 23 nt, Homo sapiens
  source 1..23: mol_type = other RNA
taagtgcttccatgttttagtag

SEQ ID NO: 294 - RNA, 23 nt, Homo sapiens
  source 1..23: mol_type = other RNA
taagtgcttccatgtttcagtgg

SEQ ID NO: 295 - RNA, 23 nt, Homo sapiens
  source 1..23: mol_type = other RNA
taagtgcttccatgtttgagtgt

SEQ ID NO: 296 - RNA, 17 nt, Homo sapiens
  source 1..17: mol_type = other RNA
taagtgcttccatgctt

SEQ ID NO: 297 - RNA, 17 nt, Homo sapiens
  source 1..17: mol_type = other RNA
taattgcttccatgttt

SEQ ID NO: 298 - RNA, 23 nt, Homo sapiens
  source 1..23: mol_type = other RNA
tcagcaccaggatattgttggag

SEQ ID NO: 299 - RNA, 23 nt, Homo sapiens
  source 1..23: mol_type = other RNA
tcaacaaaatcactgatgctgga

SEQ ID NO: 300 - RNA, 22 nt, Homo sapiens
  source 1..22: mol_type = other RNA
gatatcagctcagtaggcaccg

SEQ ID NO: 301 - RNA, 22 nt, Homo sapiens
  source 1..22: mol_type = other RNA
ctttcagtcggatgtttgcagc

SEQ ID NO: 302 - RNA, 22 nt, Homo sapiens
  source 1..22: mol_type = other RNA
tgtaaacatcctcgactggaag

SEQ ID NO: 303 - RNA, 22 nt, Homo sapiens
  source 1..22: mol_type = other RNA
tgtaaacatcctacactcagct

SEQ ID NO: 304 - RNA, 23 nt, Homo sapiens
  source 1..23: mol_type = other RNA
tgtaaacatcctacactctcagc

SEQ ID NO: 305 - RNA, 22 nt, Homo sapiens
  source 1..22: mol_type = other RNA
tgtaaacatccccgactggaag

SEQ ID NO: 306 - RNA, 22 nt, Homo sapiens
  source 1..22: mol_type = other RNA
ctttcagtcggatgtttacagc

SEQ ID NO: 307 - RNA, 22 nt, Homo sapiens
  source 1..22: mol_type = other RNA
tgtaaacatccttgactggaag

SEQ ID NO: 308 - RNA, 23 nt, Homo sapiens
  source 1..23: mol_type = other RNA
atcagggcttgtggaatgggaag

SEQ ID NO: 309 - RNA, 21 nt, Homo sapiens
  source 1..21: mol_type = other RNA
gctgcaccggagactgggtaa

SEQ ID NO: 310 - RNA, 23 nt, Homo sapiens
  source 1..23: mol_type = other RNA
tcgaggactggtggaagggcctt

SEQ ID NO: 311 - RNA, 23 nt, Homo sapiens
  source 1..23: mol_type = other RNA
ctgactgaataggtagggtcatt

SEQ ID NO: 312 - RNA, 22 nt, Homo sapiens
  source 1..22: mol_type = other RNA
agcttttgggaattcaggtagt

SEQ ID NO: 313 - RNA, 21 nt, Homo sapiens
  source 1..21: mol_type = other RNA
acctgaattaccaaaagcttt

SEQ ID NO: 314 - RNA, 22 nt, Homo sapiens
  source 1..22: mol_type = other RNA
atatacctgttcggtctcttta

SEQ ID NO: 315 - RNA, 22 nt, Homo sapiens
  source 1..22: mol_type = other RNA
aggggaccaaagagatatatag

SEQ ID NO: 316 - RNA, 24 nt, Homo sapiens
  source 1..24: mol_type = other RNA
ggttgggcagtgaggagggtgtga

SEQ ID NO: 317 - RNA, 21 nt, Homo sapiens
  source 1..21: mol_type = other RNA
tgaggagatcgtcgaggttgg

SEQ ID NO: 318 - RNA, 21 nt, Homo sapiens
  source 1..21: mol_type = other RNA
ggtggggcaatgggatcaggt

SEQ ID NO: 319 - RNA, 22 nt, Homo sapiens
  source 1..22: mol_type = other RNA
aagggcttcctctctgcaggac

SEQ ID NO: 320 - RNA, 21 nt, Homo sapiens
  source 1..21: mol_type = other RNA
aggcaagatgctggcatagct

SEQ ID NO: 321 - RNA, 23 nt, Homo sapiens
  source 1..23: mol_type = other RNA
ctgataagaacagaggcccagat

SEQ ID NO: 322 - RNA, 22 nt, Homo sapiens
  source 1..22: mol_type = other RNA
tgtgactttaagggaaatggcg

SEQ ID NO: 323 - RNA, 17 nt, Homo sapiens
  source 1..17: mol_type = other RNA
gagttctacagtcagac

SEQ ID NO: 324 - RNA, 22 nt, Homo sapiens
  source 1..22: mol_type = other RNA
agaaggggtgaaatttaaacgt

SEQ ID NO: 325 - RNA, 19 nt, Homo sapiens
  source 1..19: mol_type = other RNA
tggggcggagcttccggag

SEQ ID NO: 326 - RNA, 22 nt, Homo sapiens
  source 1..22: mol_type = other RNA
tggggcggagcttccggaggcc

SEQ ID NO: 327 - RNA, 25 nt, Homo sapiens
  source 1..25: mol_type = other RNA
cttccagacgctccgccccacgtcg

SEQ ID NO: 328 - RNA, 17 nt, Homo sapiens
  source 1..17: mol_type = other RNA
gcttctgtagtgtagtc

SEQ ID NO: 329 - RNA, 23 nt, Homo sapiens
  source 1..23: mol_type = other RNA
agaagaaggcggtcggtctgcgg

SEQ ID NO: 330 - RNA, 23 nt, Homo sapiens
  source 1..23: mol_type = other RNA
tgtggaaggtagacggccagaga

SEQ ID NO: 331 - RNA, 23 nt, Homo sapiens
  source 1..23: mol_type = other RNA
tctgggaggttgtagcagtggaa

SEQ ID NO: 332 - RNA, 17 nt, Homo sapiens
  source 1..17: mol_type = other RNA
cgcgccgggcccgggtt

SEQ ID NO: 333 - RNA, 18 nt, Homo sapiens
  source 1..18: mol_type = other RNA
cggggcggcaggggcctc

SEQ ID NO: 334 - RNA, 22 nt, Homo sapiens
  source 1..22: mol_type = other RNA
tggaagggagaagagctttaat

SEQ ID NO: 335 - RNA, 22 nt, Homo sapiens
  source 1..22: mol_type = other RNA
aaaagctgggttgagagggcga

SEQ ID NO: 336 - RNA, 22 nt, Homo sapiens
  source 1..22: mol_type = other RNA
aaaagctgggttgagagggcaa

SEQ ID NO: 337 - RNA, 20 nt, Homo sapiens
  source 1..20: mol_type = other RNA
aaaagctgggttgagagggt

SEQ ID NO: 338 - RNA, 19 nt, Homo sapiens
  source 1..19: mol_type = other RNA
aaaagctgggttgagagga

SEQ ID NO: 339 - RNA, 18 nt, Homo sapiens
  source 1..18: mol_type = other RNA
aaagctgggttgagaagg

SEQ ID NO: 340 - RNA, 21 nt, Homo sapiens
  source 1..21: mol_type = other RNA
cacattacacggtcgacctct

SEQ ID NO: 341 - RNA, 22 nt, Homo sapiens
  source 1..22: mol_type = other RNA
aggtggtccgtggcgcgttcgc

SEQ ID NO: 342 - RNA, 22 nt, Homo sapiens
  source 1..22: mol_type = other RNA
cccaatacacggtcgacctctt

SEQ ID NO: 343 - RNA, 23 nt, Homo sapiens
  source 1..23: mol_type = other RNA
aggttgtccgtggtgagttcgca

SEQ ID NO: 344 - RNA, 20 nt, Homo sapiens
  source 1..20: mol_type = other RNA
actgccccaggtgctgctgg

SEQ ID NO: 345 - RNA, 23 nt, Homo sapiens
  source 1..23: mol_type = other RNA
cgcatcccctagggcattggtgt

SEQ ID NO: 346 - RNA, 23 nt, Homo sapiens
  source 1..23: mol_type = other RNA
cctagtaggtgtccagtaagtgt

SEQ ID NO: 347 - RNA, 22 nt, Homo sapiens
  source 1..22: mol_type = other RNA
tattgcacattactaagttgca

SEQ ID NO: 348 - RNA, 20 nt, Homo sapiens
  source 1..20: mol_type = other RNA
cctctgggcccttcctccag

SEQ ID NO: 349 - RNA, 22 nt, Homo sapiens
  source 1..22: mol_type = other RNA
ctggccctctctgcccttccgt

SEQ ID NO: 350 - RNA, 23 nt, Homo sapiens
  source 1..23: mol_type = other RNA
gggggggcaggaggggctcaggg

SEQ ID NO: 351 - RNA, 22 nt, Homo sapiens
  source 1..22: mol_type = other RNA
aacacacctggttaacctcttt

SEQ ID NO: 352 - RNA, 23 nt, Homo sapiens
  source 1..23: mol_type = other RNA
gaggttttctgggtttctgtttc

SEQ ID NO: 353 - RNA, 23 nt, Homo sapiens
  source 1..23: mol_type = other RNA
gcaaagcacacggcctgcagaga

SEQ ID NO: 354 - RNA, 22 nt, Homo sapiens
  source 1..22: mol_type = other RNA
tctctgggcctgtgtcttaggc

SEQ ID NO: 355 - RNA, 21 nt, Homo sapiens
  source 1..21: mol_type = other RNA
gcccctgggcctatcctagaa

SEQ ID NO: 356 - RNA, 22 nt, Homo sapiens
  source 1..22: mol_type = other RNA
ctaggtatggtcccagggatcc

SEQ ID NO: 357 - RNA, 23 nt, Homo sapiens
  source 1..23: mol_type = other RNA
tcaagagcaataacgaaaaatgt

SEQ ID NO: 358 - RNA, 22 nt, Homo sapiens
  source 1..22: mol_type = other RNA
ctcctatatgatgcctttcttc

SEQ ID NO: 359 - RNA, 21 nt, Homo sapiens
  source 1..21: mol_type = other RNA
gaacggcttcatacaggagtt

SEQ ID NO: 360 - RNA, 22 nt, Homo sapiens
  source 1..22: mol_type = other RNA
aacaatatcctggtgctgagtg

SEQ ID NO: 361 - RNA, 23 nt, Homo sapiens
  source 1..23: mol_type = other RNA
tgagcgcctcgacgacagagccg

SEQ ID NO: 362 - RNA, 23 nt, Homo sapiens
  source 1..23: mol_type = other RNA
tccctgtcctccaggagctcacg

SEQ ID NO: 363 - RNA, 21 nt, Homo sapiens
  source 1..21: mol_type = other RNA
gtgcattgtagttgcattgca

SEQ ID NO: 364 - RNA, 20 nt, Homo sapiens
  source 1..20: mol_type = other RNA
gtgcattgctgttgcattgc

SEQ ID NO: 365 - RNA, 22 nt, Homo sapiens
  source 1..22: mol_type = other RNA
ttataaagcaatgagactgatt

SEQ ID NO: 366 - RNA, 23 nt, Homo sapiens
  source 1..23: mol_type = other RNA
tctcacacagaaatcgcacccgt

SEQ ID NO: 367 - RNA, 21 nt, Homo sapiens
  source 1..21: mol_type = other RNA
aggggtgctatctgtgattga

SEQ ID NO: 368 - RNA, 22 nt, Homo sapiens
  source 1..22: mol_type = other RNA
gccctgaacgaggggtctggag

SEQ ID NO: 369 - RNA, 22 nt, Homo sapiens
  source 1..22: mol_type = other RNA
gctgactcctagtccagggctc

SEQ ID NO: 370 - RNA, 23 nt, Homo sapiens
  source 1..23: mol_type = other RNA
tgtctgcccgcatgcctgcctct

SEQ ID NO: 371 - RNA, 22 nt, Homo sapiens
  source 1..22: mol_type = other RNA
caatcactaactccactgccat

SEQ ID NO: 372 - RNA, 22 nt, Homo sapiens
  source 1..22: mol_type = other RNA
aatcactaaccacacggccagg

SEQ ID NO: 373 - RNA, 23 nt, Homo sapiens
  source 1..23: mol_type = other RNA
aggcagtgtagttagctgattgc

SEQ ID NO: 374 - RNA, 23 nt, Homo sapiens
  source 1..23: mol_type = other RNA
cctccgtgttacctgtcctctag

SEQ ID NO: 375 - RNA, 23 nt, Homo sapiens
  source 1..23: mol_type = other RNA
tgaggatggatagcaaggaagcc

SEQ ID NO: 376 - RNA, 24 nt, Homo sapiens
  source 1..24: mol_type = other RNA
acaaaaaaaaaagcccaacccttc

SEQ ID NO: 377 - RNA, 22 nt, Homo sapiens
  source 1..22: mol_type = other RNA
tgttgtacttttttttttgttc

SEQ ID NO: 378 - RNA, 23 nt, Homo sapiens
  source 1..23: mol_type = other RNA
tcccccaggtgtgattctgattt

SEQ ID NO: 379 - RNA, 23 nt, Homo sapiens
  source 1..23: mol_type = other RNA
tagccttcagatcttggtgtttt

SEQ ID NO: 380 - RNA, 23 nt, Homo sapiens
  source 1..23: mol_type = other RNA
ccacttggatctgaaggctgccc

SEQ ID NO: 381 - RNA, 21 nt, Homo sapiens
  source 1..21: mol_type = other RNA
tctctcggctcctcgcggctc

SEQ ID NO: 382 - RNA, 22 nt, Homo sapiens
  source 1..22: mol_type = other RNA
ttatcagaatctccaggggtac

SEQ ID NO: 383 - RNA, 22 nt, Homo sapiens
  source 1..22: mol_type = other RNA
aacacacctattcaaggattca

SEQ ID NO: 384 - RNA, 24 nt, Homo sapiens
  source 1..24: mol_type = other RNA
aatccttggaacctaggtgtgagt

SEQ ID NO: 385 - RNA, 22 nt, Homo sapiens
  source 1..22: mol_type = other RNA
aattgcacggtatccatctgta

SEQ ID NO: 386 - RNA, 22 nt, Homo sapiens
  source 1..22: mol_type = other RNA
cgggtggatcacgatgcaattt

SEQ ID NO: 387 - RNA, 22 nt, Homo sapiens
  source 1..22: mol_type = other RNA
taatgcccctaaaaatccttat

SEQ ID NO: 388 - RNA, 22 nt, Homo sapiens
  source 1..22: mol_type = other RNA
agggactttcaggggcagctgt

SEQ ID NO: 389 - RNA, 22 nt, Homo sapiens
  source 1..22: mol_type = other RNA
aattgcactttagcaatggtga

SEQ ID NO: 390 - RNA, 23 nt, Homo sapiens
  source 1..23: mol_type = other RNA
acctggacccagcgtagacaaag

SEQ ID NO: 391 - RNA, 21 nt, Homo sapiens
  source 1..21: mol_type = other RNA
aataatacatggttgatcttt

SEQ ID NO: 392 - RNA, 22 nt, Homo sapiens
  source 1..22: mol_type = other RNA
agatcgaccgtgttatattcgc

SEQ ID NO: 393 - RNA, 22 nt, Homo sapiens
  source 1..22: mol_type = other RNA
gcctgctggggtggaacctggt

SEQ ID NO: 394 - RNA, 22 nt, Homo sapiens
  source 1..22: mol_type = other RNA
caggtcacgtctctgcagttac

SEQ ID NO: 395 - RNA, 20 nt, Homo sapiens
  source 1..20: mol_type = other RNA
actcaaactgtgggggcact

SEQ ID NO: 396 - RNA, 22 nt, Homo sapiens
  source 1..22: mol_type = other RNA
actcaaaagatggcggcacttt

SEQ ID NO: 397 - RNA, 23 nt, Homo sapiens
  source 1..23: mol_type = other RNA
aaagtgctgcgacatttgagcgt

SEQ ID NO: 398 - RNA, 23 nt, Homo sapiens
  source 1..23: mol_type = other RNA
gaagtgcttcgattttggggtgt

SEQ ID NO: 399 - RNA, 22 nt, Homo sapiens
  source 1..22: mol_type = other RNA
cttatcagattgtattgtaatt

SEQ ID NO: 400 - RNA, 22 nt, Homo sapiens
  source 1..22: mol_type = other RNA
ttataatacaacctgataagtg

SEQ ID NO: 401 - RNA, 22 nt, Homo sapiens
  source 1..22: mol_type = other RNA
atataatacaacctgctaagtg

SEQ ID NO: 402 - RNA, 22 nt, Homo sapiens
  source 1..22: mol_type = other RNA
ataatacaacctgctaagtgct

SEQ ID NO: 403 - RNA, 22 nt, Homo sapiens
  source 1..22: mol_type = other RNA
tttgttcgttcggctcgcgtga

SEQ ID NO: 404 - RNA, 21 nt, Homo sapiens
  source 1..21: mol_type = other RNA
ggtagattttccttctatggt

SEQ ID NO: 405 - RNA, 21 nt, Homo sapiens
  source 1..21: mol_type = other RNA
atcatagaggaaaatccacgt

SEQ ID NO: 406 - RNA, 22 nt, Homo sapiens
  source 1..22: mol_type = other RNA
atcatagaggaaaatccatgtt

SEQ ID NO: 407 - RNA, 21 nt, Homo sapiens
  source 1..21: mol_type = other RNA
aacatagaggaaattccacgt

SEQ ID NO: 408 - RNA, 21 nt, Homo sapiens
  source 1..21: mol_type = other RNA
ggtggatattccttctatgtt

SEQ ID NO: 409 - RNA, 22 nt, Homo sapiens
  source 1..22: mol_type = other RNA
atcacacaaaggcaacttttgt

SEQ ID NO: 410 - RNA, 19 nt, Homo sapiens
  source 1..19: mol_type = other RNA
actggacttggaggcagaa

SEQ ID NO: 411 - RNA, 25 nt, Homo sapiens
  source 1..25: mol_type = other RNA
actggacttggagtcagaagagtgg

SEQ ID NO: 412 - RNA, 20 nt, Homo sapiens
  source 1..20: mol_type = other RNA
actggacttggagtcagaaa

SEQ ID NO: 413 - RNA, 19 nt, Homo sapiens
  source 1..19: mol_type = other RNA
actggacttggagtcagga

SEQ ID NO: 414 - RNA, 20 nt, Homo sapiens
  source 1..20: mol_type = other RNA
actggacttggagccagaag

SEQ ID NO: 415 - RNA, 20 nt, Homo sapiens
  source 1..20: mol_type = other RNA
actgggcttggagtcagaag

SEQ ID NO: 416 - RNA, 21 nt, Homo sapiens
  source 1..21: mol_type = other RNA
actggacttggtgtcagatgg

SEQ ID NO: 417 - RNA, 21 nt, Homo sapiens
  source 1..21: mol_type = other RNA
actggactaggagtcagaagg

SEQ ID NO: 418 - RNA, 21 nt, Homo sapiens
  source 1..21: mol_type = other RNA
tggtagactatggaacgtagg

SEQ ID NO: 419 - RNA, 22 nt, Homo sapiens
  source 1..22: mol_type = other RNA
tatgtaatatggtccacatctt

SEQ ID NO: 420 - RNA, 22 nt, Homo sapiens
  source 1..22: mol_type = other RNA
tatacaagggcaagctctctgt

SEQ ID NO: 421 - RNA, 22 nt, Homo sapiens
  source 1..22: mol_type = other RNA
agcgaggttgccctttgtatat

SEQ ID NO: 422 - RNA, 21 nt, Homo sapiens
  source 1..21: mol_type = other RNA
aatcattcacggacaacactt

SEQ ID NO: 423 - RNA, 22 nt, Homo sapiens
  source 1..22: mol_type = other RNA
gaagttgttcgtggtggattcg

SEQ ID NO: 424 - RNA, 22 nt, Homo sapiens
  source 1..22: mol_type = other RNA
agatcagaaggtgattgtggct

SEQ ID NO: 425 - RNA, 20 nt, Homo sapiens
  source 1..20: mol_type = other RNA
attcctagaaattgttcata

SEQ ID NO: 426 - RNA, 26 nt, Homo sapiens
  source 1..26: mol_type = other RNA
aagaggaagaaatggctggttctcag

SEQ ID NO: 427 - RNA, 21 nt, Homo sapiens
  source 1..21: mol_type = other RNA
acagggccgcagatggagact

SEQ ID NO: 428 - RNA, 22 nt, Homo sapiens
  source 1..22: mol_type = other RNA
ggaggaaccttggagcttcggc

SEQ ID NO: 429 - RNA, 22 nt, Homo sapiens
  source 1..22: mol_type = other RNA
tcaggtgtggaaactgaggcag

SEQ ID NO: 430 - RNA, 22 nt, Homo sapiens
  source 1..22: mol_type = other RNA
gaatgttgctcggtgaacccct

SEQ ID NO: 431 - RNA, 23 nt, Homo sapiens
  source 1..23: mol_type = other RNA
aggttacccgagcaactttgcat

SEQ ID NO: 432 - RNA, 21 nt, Homo sapiens
  source 1..21: mol_type = other RNA
aatataacacagatggcctgt

SEQ ID NO: 433 - RNA, 21 nt, Homo sapiens
  source 1..21: mol_type = other RNA
tagtagaccgtatagcgtacg

SEQ ID NO: 434 - RNA, 23 nt, Homo sapiens
  source 1..23: mol_type = other RNA
acttcacctggtccactagccgt

SEQ ID NO: 435 - RNA, 23 nt, Homo sapiens
  source 1..23: mol_type = other RNA
atcaacagacattaattgggcgc

SEQ ID NO: 436 - RNA, 22 nt, Homo sapiens
  source 1..22: mol_type = other RNA
actggacttagggtcagaaggc

SEQ ID NO: 437 - RNA, 23 nt, Homo sapiens
  source 1..23: mol_type = other RNA
agctcggtctgaggcccctcagt

SEQ ID NO: 438 - RNA, 23 nt, Homo sapiens
  source 1..23: mol_type = other RNA
tgaggggcagagagcgagacttt

SEQ ID NO: 439 - RNA, 22 nt, Homo sapiens
  source 1..22: mol_type = other RNA
cagcagcaattcatgttttgaa

SEQ ID NO: 440 - RNA, 23 nt, Homo sapiens
  source 1..23: mol_type = other RNA
aatgacacgatcactcccgttga

SEQ ID NO: 441 - RNA, 18 nt, Homo sapiens
  source 1..18: mol_type = other RNA
gggctcacatcaccccat

SEQ ID NO: 442 - RNA, 17 nt, Homo sapiens
  source 1..17: mol_type = other RNA
accccactcctggtacc

SEQ ID NO: 443 - RNA, 22 nt, Homo sapiens
  source 1..22: mol_type = other RNA
taatactgtctggtaaaaccgt

SEQ ID NO: 444 - RNA, 21 nt, Homo sapiens
  source 1..21: mol_type = other RNA
tgtcttgcaggccgtcatgca

SEQ ID NO: 445 - RNA, 23 nt, Homo sapiens
  source 1..23: mol_type = other RNA
tcttggagtaggtcattgggtgg

SEQ ID NO: 446 - RNA, 22 nt, Homo sapiens
  source 1..22: mol_type = other RNA
atcatgatgggctcctcggtgt

SEQ ID NO: 447 - RNA, 22 nt, Homo sapiens
  source 1..22: mol_type = other RNA
tacggtgagcctgtcattattc

SEQ ID NO: 448 - RNA, 22 nt, Homo sapiens
  source 1..22: mol_type = other RNA
acctgtctgtggaaaggagcta

SEQ ID NO: 449 - RNA, 22 nt, Homo sapiens
  source 1..22: mol_type = other RNA
tgttgggattcagcaggaccat

SEQ ID NO: 450 - RNA, 22 nt, Homo sapiens
  source 1..22: mol_type = other RNA
gcgactctgaaaactagaaggt

SEQ ID NO: 451 - RNA, 22 nt, Homo sapiens
  source 1..22: mol_type = other RNA
atggccagagctcacacagagg

SEQ ID NO: 452 - RNA, 17 nt, Homo sapiens
  source 1..17: mol_type = other RNA
ttggaggcgtgggtttt

SEQ ID NO: 453 - RNA, 20 nt, Homo sapiens
  source 1..20: mol_type = other RNA
ggctccttggtctaggggta

SEQ ID NO: 454 - RNA, 17 nt, Homo sapiens
  source 1..17: mol_type = other RNA
tggtagagctgaggaca

SEQ ID NO: 455 - RNA, 20 nt, Homo sapiens
  source 1..20: mol_type = other RNA
ggatccgagtcacggcacca

SEQ ID NO: 456 - RNA, 17 nt, Homo sapiens
  source 1..17: mol_type = other RNA
agggtgtgtgtgttttt

SEQ ID NO: 457 - RNA, 19 nt, Homo sapiens
  source 1..19: mol_type = other RNA
agaggtaggtgtggaagaa

SEQ ID NO: 458 - RNA, 23 nt, Homo sapiens
  source 1..23: mol_type = other RNA
gattgagactagtagggctaggc

SEQ ID NO: 459 - RNA, 22 nt, Homo sapiens
  source 1..22: mol_type = other RNA
ttgcatatgtaggatgtcccat

SEQ ID NO: 460 - RNA, 20 nt, Homo sapiens
  source 1..20: mol_type = other RNA
taacggccgcggtaccctaa

SEQ ID NO: 461 - RNA, 18 nt, Homo sapiens
  source 1..18: mol_type = other RNA
agggggcgggctccggcg

SEQ ID NO: 462 - RNA, 22 nt, Homo sapiens
  source 1..22: mol_type = other RNA
tggcagtgtattgttagctggt

SEQ ID NO: 463 - RNA, 22 nt, Homo sapiens
  source 1..22: mol_type = other RNA
aggcagtgtattgttagctggc

SEQ ID NO: 464 - RNA, 25 nt, Homo sapiens
  source 1..25: mol_type = other RNA
taggcagtgtattgctagcggctgt

SEQ ID NO: 465 - RNA, 22 nt, Homo sapiens
  source 1..22: mol_type = other RNA
attgggaacattttgcatgtat

SEQ ID NO: 466 - RNA, 22 nt, Homo sapiens
  source 1..22: mol_type = other RNA
attggggacattttgcattcat

SEQ ID NO: 467 - RNA, 22 nt, Homo sapiens
  source 1..22: mol_type = other RNA
ttttgcgatgtgttcctaatat

SEQ ID NO: 468 - RNA, 22 nt, Homo sapiens
  source 1..22: mol_type = other RNA
ttgggatcattttgcatccata

SEQ ID NO: 469 - RNA, 22 nt, Homo sapiens
  source 1..22: mol_type = other RNA
ttttgcaatatgttcctgaata

SEQ ID NO: 470 - RNA, 17 nt, Homo sapiens
  source 1..17: mol_type = other RNA
gggagaagggtcggggc

SEQ ID NO: 471 - RNA, 22 nt, Homo sapiens
  source 1..22: mol_type = other RNA
gctaaggaagtcctgtgctcag

SEQ ID NO: 472 - RNA, 22 nt, Homo sapiens
  source 1..22: mol_type = other RNA
atagcagcatgaacctgtctca

SEQ ID NO: 473 - RNA, 22 nt, Homo sapiens
  source 1..22: mol_type = other RNA
aactgtttgcagaggaaactga

SEQ ID NO: 474 - RNA, 17 nt, Homo sapiens
  source 1..17: mol_type = other RNA
atggagaaggcttctga

SEQ ID NO: 475 - RNA, 17 nt, Homo sapiens
  source 1..17: mol_type = other RNA
ccccggggagcccggcg

SEQ ID NO: 476 - RNA, 21 nt, Homo sapiens
  source 1..21: mol_type = other RNA
tcgtgcatatatctaccacat

SEQ ID NO: 477 - RNA, 21 nt, Homo sapiens
  source 1..21: mol_type = other RNA
tgtggtagatatatgcacgat

SEQ ID NO: 478 - RNA, 23 nt, Homo sapiens
  source 1..23: mol_type = other RNA
tagtgcaatattgcttatagggt

SEQ ID NO: 479 - RNA, 21 nt, Homo sapiens
  source 1..21: mol_type = other RNA
gcagtccatgggcatatacac

SEQ ID NO: 480 - RNA, 22 nt, Homo sapiens
  source 1..22: mol_type = other RNA
tatgtgcctttggactacatcg

SEQ ID NO: 481 - RNA, 23 nt, Homo sapiens
  source 1..23: mol_type = other RNA
gaagatggtgctgtgctgaggaa

SEQ ID NO: 482 - RNA, 22 nt, Homo sapiens
  source 1..22: mol_type = other RNA
agcccgccccagccgaggttct

SEQ ID NO: 483 - RNA, 23 nt, Homo sapiens
  source 1..23: mol_type = other RNA
gccccggcgcgggcgggttctgg

SEQ ID NO: 484 - RNA, 23 nt, Homo sapiens
  source 1..23: mol_type = other RNA
cgggctgtccggaggggtcggct

SEQ ID NO: 485 - RNA, 22 nt, Homo sapiens
  source 1..22: mol_type = other RNA
tttcccttcagagcctggcttt

SEQ ID NO: 486 - RNA, 24 nt, Homo sapiens
  source 1..24: mol_type = other RNA
gatgcgccgcccactgccccgcgc

SEQ ID NO: 487 - RNA, 22 nt, Homo sapiens
  source 1..22: mol_type = other RNA
gcgggggtggcggcggcatccc

SEQ ID NO: 488 - RNA, 18 nt, Homo sapiens
  source 1..18: mol_type = other RNA
cggtgagcgctcgctggc

SEQ ID NO: 489 - RNA, 21 nt, Homo sapiens
  source 1..21: mol_type = other RNA
tcactcctctcctcccgtctt

SEQ ID NO: 490 - RNA, 22 nt, Homo sapiens
  source 1..22: mol_type = other RNA
aagacgggaggaaagaagggag

SEQ ID NO: 491 - RNA, 22 nt, Homo sapiens
  source 1..22: mol_type = other RNA
tcaggctcagtcccctcccgat

SEQ ID NO: 492 - RNA, 22 nt, Homo sapiens
  source 1..22: mol_type = other RNA
gtcatacacggctctcctctct

SEQ ID NO: 493 - RNA, 22 nt, Homo sapiens
  source 1..22: mol_type = other RNA
agaggctggccgtgatgaattc

SEQ ID NO: 494 - RNA, 21 nt, Homo sapiens
  source 1..21: mol_type = other RNA
cggggcagctcagtacaggat

SEQ ID NO: 495 - RNA, 22 nt, Homo sapiens
  source 1..22: mol_type = other RNA
aatcatacagggacatccagtt

SEQ ID NO: 496 - RNA, 22 nt, Homo sapiens
  source 1..22: mol_type = other RNA
aatcgtacagggtcatccactt

SEQ ID NO: 497 - RNA, 22 nt, Homo sapiens
  source 1..22: mol_type = other RNA
gtggttatccctgtcctgttcg

SEQ ID NO: 498 - RNA, 21 nt, Homo sapiens
  source 1..21: mol_type = other RNA
ttgaaaggctatttcttggtc

SEQ ID NO: 499 - RNA, 22 nt, Homo sapiens
  source 1..22: mol_type = other RNA
gtgacatcacatatacggcagc

SEQ ID NO: 500 - RNA, 22 nt, Homo sapiens
  source 1..22: mol_type = other RNA
caacctggaggactccatgctg

SEQ ID NO: 501 - RNA, 20 nt, Homo sapiens
  source 1..20: mol_type = other RNA
ccatggatctccaggtgggt

SEQ ID NO: 502 - RNA, 22 nt, Homo sapiens
  source 1..22: mol_type = other RNA
cttatgcaagattcccttctac

SEQ ID NO: 503 - RNA, 22 nt, Homo sapiens
  source 1..22: mol_type = other RNA
agtggggaacccttccatgagg

SEQ ID NO: 504 - RNA, 23 nt, Homo sapiens
  source 1..23: mol_type = other RNA
aggacctgcgggacaagattctt

SEQ ID NO: 505 - RNA, 22 nt, Homo sapiens
  source 1..22: mol_type = other RNA
tgaaggtctactgtgtgccagg

SEQ ID NO: 506 - RNA, 22 nt, Homo sapiens
  source 1..22: mol_type = other RNA
tgaaacatacacgggaaacctc

SEQ ID NO: 507 - RNA, 23 nt, Homo sapiens
  source 1..23: mol_type = other RNA
aggttgtccgtgttgtcttctct

SEQ ID NO: 508 - RNA, 22 nt, Homo sapiens
  source 1..22: mol_type = other RNA
aaacaaacatggtgcacttctt

SEQ ID NO: 509 - RNA, 22 nt, Homo sapiens
  source 1..22: mol_type = other RNA
gaagttgcccatgttattttcg

SEQ ID NO: 510 - RNA, 22 nt, Homo sapiens
  source 1..22: mol_type = other RNA
tgagtattacatggccaatctc

SEQ ID NO: 511 - RNA, 21 nt, Homo sapiens
  source 1..21: mol_type = other RNA
cagcagcacactgtggtttgt

SEQ ID NO: 512 - RNA, 23 nt, Homo sapiens
  source 1..23: mol_type = other RNA
tttcaagccagggggcgtttttc

SEQ ID NO: 513 - RNA, 22 nt, Homo sapiens
  source 1..22: mol_type = other RNA
aacatcacagcaagtctgtgct

SEQ ID NO: 514 - RNA, 21 nt, Homo sapiens
  source 1..21: mol_type = other RNA
ttaagacttgcagtgatgttt

SEQ ID NO: 515 - RNA, 22 nt, Homo sapiens
  source 1..22: mol_type = other RNA
aacatcactgcaagtcttaaca

SEQ ID NO: 516 - RNA, 21 nt, Homo sapiens
  source 1..21: mol_type = other RNA
acagacttgctgtgatgttca

SEQ ID NO: 517 - RNA, 22 nt, Homo sapiens
  source 1..22: mol_type = other RNA
ttctgcctctgtccaggtcctt

SEQ ID NO: 518 - RNA, 24 nt, Homo sapiens
  source 1..24: mol_type = other RNA
agggctggactcagcggcggagct

SEQ ID NO: 519 - RNA, 23 nt, Homo sapiens
  source 1..23: mol_type = other RNA
taatccttgctacctgggtgaga

SEQ ID NO: 520 - RNA, 22 nt, Homo sapiens
  source 1..22: mol_type = other RNA
ttttgtgtctcccattccccag

SEQ ID NO: 521 - RNA, 22 nt, Homo sapiens
  source 1..22: mol_type = other RNA
agggggatggcagagcaaaatt

SEQ ID NO: 522 - RNA, 22 nt, Homo sapiens
  source 1..22: mol_type = other RNA
aatgcacccgggcaaggattct

SEQ ID NO: 523 - RNA, 22 nt, Homo sapiens
  source 1..22: mol_type = other RNA
aatgcacctgggcaaggattca

SEQ ID NO: 524 - RNA, 21 nt, Homo sapiens
  source 1..21: mol_type = other RNA
atccttgctatctgggtgcta

SEQ ID NO: 525 - RNA, 23 nt, Homo sapiens
  source 1..23: mol_type = other RNA
ggggtattgtttccgctgccagg

SEQ ID NO: 526 - RNA, 23 nt, Homo sapiens
  source 1..23: mol_type = other RNA
tagcagcgggaacagttctgcag

SEQ ID NO: 527 - RNA, 21 nt, Homo sapiens
  source 1..21: mol_type = other RNA
gggagtgcagggcagggtttc

SEQ ID NO: 528 - RNA, 22 nt, Homo sapiens
  source 1..22: mol_type = other RNA
agaccctggtctgcactctatc

SEQ ID NO: 529 - RNA, 22 nt, Homo sapiens
  source 1..22: mol_type = other RNA
cgtcaacacttgctggtttcct

SEQ ID NO: 530 - RNA, 21 nt, Homo sapiens
  source 1..21: mol_type = other RNA
taaggcacccttctgagtaga

SEQ ID NO: 531 - RNA, 22 nt, Homo sapiens
  source 1..22: mol_type = other RNA
tattcaggaaggtgttacttaa

SEQ ID NO: 532 - RNA, 21 nt, Homo sapiens
  source 1..21: mol_type = other RNA
ttttgcaccttttggagtgaa

SEQ ID NO: 533 - RNA, 23 nt, Homo sapiens
  source 1..23: mol_type = other RNA
tgattgtagccttttggagtaga

SEQ ID NO: 534 - RNA, 23 nt, Homo sapiens
  source 1..23: mol_type = other RNA
tactccagagggcgtcactcatg

SEQ ID NO: 535 - RNA, 22 nt, Homo sapiens
  source 1..22: mol_type = other RNA
tactgcagacgtggcaatcatg

SEQ ID NO: 536 - RNA, 22 nt, Homo sapiens
  source 1..22: mol_type = other RNA
tgattggtacgtctgtgggtag

SEQ ID NO: 537 - RNA, 21 nt, Homo sapiens
  source 1..21: mol_type = other RNA
tactgcagacagtggcaatca

SEQ ID NO: 538 - RNA, 21 nt, Homo sapiens
  source 1..21: mol_type = other RNA
attgaaacctctaagagtgga

SEQ ID NO: 539 - RNA, 22 nt, Homo sapiens
  source 1..22: mol_type = other RNA
tactcaggagagtggcaatcac

SEQ ID NO: 540 - RNA, 21 nt, Homo sapiens
  source 1..21: mol_type = other RNA
gtgtcttttgctctgcagtca

SEQ ID NO: 541 - RNA, 22 nt, Homo sapiens
  source 1..22: mol_type = other RNA
aagtgctgtcatagctgaggtc

SEQ ID NO: 542 - RNA, 23 nt, Homo sapiens
  source 1..23: mol_type = other RNA
cactcagccttgagggcactttc

SEQ ID NO: 543 - RNA, 23 nt, Homo sapiens
  source 1..23: mol_type = other RNA
taaatttcacctttctgagaagg

SEQ ID NO: 544 - RNA, 18 nt, Homo sapiens
  source 1..18: mol_type = other RNA
ttcacagggaggtgtcat

SEQ ID NO: 545 - RNA, 22 nt, Homo sapiens
  source 1..22: mol_type = other RNA
ttcacaaggaggtgtcatttat

SEQ ID NO: 546 - RNA, 23 nt, Homo sapiens
  source 1..23: mol_type = other RNA
taaatttcacctttctgagaaga

SEQ ID NO: 547 - RNA, 22 nt, Homo sapiens
  source 1..22: mol_type = other RNA
ttctcaaggaggtgtcgtttat

SEQ ID NO: 548 - RNA, 21 nt, Homo sapiens
  source 1..21: mol_type = other RNA
attgacacttctgtgagtaga

SEQ ID NO: 549 - RNA, 23 nt, Homo sapiens
  source 1..23: mol_type = other RNA
tactctggagagtgacaatcatg

SEQ ID NO: 550 - RNA, 21 nt, Homo sapiens
  source 1..21: mol_type = other RNA
attgacacctctgtgagtgga

SEQ ID NO: 551 - RNA, 22 nt, Homo sapiens
  source 1..22: mol_type = other RNA
ttctcaagagggaggcaatcat

SEQ ID NO: 552 - RNA, 22 nt, Homo sapiens
  source 1..22: mol_type = other RNA
gagtgccttcttttggagcgtt

SEQ ID NO: 553 - RNA, 24 nt, Homo sapiens
  source 1..24: mol_type = other RNA
ttctccaaaagaaagcactttctg

SEQ ID NO: 554 - RNA, 18 nt, Homo sapiens
  source 1..18: mol_type = other RNA
tgcttcctttcagagggt

SEQ ID NO: 555 - RNA, 23 nt, Homo sapiens
  source 1..23: mol_type = other RNA
ttctcgaggaaagaagcactttc

SEQ ID NO: 556 - RNA, 22 nt, Homo sapiens
  source 1..22: mol_type = other RNA
atctggaggtaagaagcacttt

SEQ ID NO: 557 - RNA, 22 nt, Homo sapiens
  source 1..22: mol_type = other RNA
atcgtgcatccctttagagtgt

SEQ ID NO: 558 - RNA, 22 nt, Homo sapiens
  source 1..22: mol_type = other RNA
atcgtgcatccctttagagtgt

SEQ ID NO: 559 - RNA, 22 nt, Homo sapiens
  source 1..22: mol_type = other RNA
atcgtgcatccttttagagtgt

SEQ ID NO: 560 - RNA, 22 nt, Homo sapiens
  source 1..22: mol_type = other RNA
caaagcgctcccctttagaggt

SEQ ID NO: 561 - RNA, 23 nt, Homo sapiens
  source 1..23: mol_type = other RNA
caaagcgcttctctttagagtgt

SEQ ID NO: 562 - RNA, 21 nt, Homo sapiens
  source 1..21: mol_type = other RNA
caaagcgcttccctttggagc

SEQ ID NO: 563 - RNA, 21 nt, Homo sapiens
  source 1..21: mol_type = other RNA
aaagcgcttcccttcagagtg

SEQ ID NO: 564 - RNA, 21 nt, Homo sapiens
  source 1..21: mol_type = other RNA
gaaagcgcttctctttagagg

SEQ ID NO: 565 - RNA, 21 nt, Homo sapiens
  source 1..21: mol_type = other RNA
tcatcctcgtctccctcccag

SEQ ID NO: 566 - RNA, 22 nt, Homo sapiens
  source 1..22: mol_type = other RNA
agggaaggggacgagggttggg

SEQ ID NO: 567 - RNA, 22 nt, Homo sapiens
  source 1..22: mol_type = other RNA
aaagtgcatccttttagaggtt

SEQ ID NO: 568 - RNA, 22 nt, Homo sapiens
  source 1..22: mol_type = other RNA
ctctagagggaagcgctttctg

SEQ ID NO: 569 - RNA, 22 nt, Homo sapiens
  source 1..22: mol_type = other RNA
aaagtgcatctttttagaggat

SEQ ID NO: 570 - RNA, 22 nt, Homo sapiens
  source 1..22: mol_type = other RNA
caaagtgcctccctttagagtg

SEQ ID NO: 571 - RNA, 22 nt, Homo sapiens
  source 1..22: mol_type = other RNA
aagtgcctccttttagagtgtt

SEQ ID NO: 572 - RNA, 22 nt, Homo sapiens
  source 1..22: mol_type = other RNA
aaagtgcttccctttggactgt

SEQ ID NO: 573 - RNA, 21 nt, Homo sapiens
  source 1..21: mol_type = other RNA
ctccagagggaagtactttct

SEQ ID NO: 574 - RNA, 21 nt, Homo sapiens
  source 1..21: mol_type = other RNA
aaagtgcttccttttagaggg

SEQ ID NO: 575 - RNA, 22 nt, Homo sapiens
  source 1..22: mol_type = other RNA
aaagtgcttccttttagagggt

SEQ ID NO: 576 - RNA, 22 nt, Homo sapiens
  source 1..22: mol_type = other RNA
aaagtgcttctctttggtgggt

SEQ ID NO: 577 - RNA, 20 nt, Homo sapiens
  source 1..20: mol_type = other RNA
ctacaaagggaagccctttc

SEQ ID NO: 578 - RNA, 21 nt, Homo sapiens
  source 1..21: mol_type = other RNA
aaagtgcttcctttttgaggg

SEQ ID NO: 579 - RNA, 22 nt, Homo sapiens
  source 1..22: mol_type = other RNA
aagtgcttccttttagagggtt

SEQ ID NO: 580 - RNA, 24 nt, Homo sapiens
  source 1..24: mol_type = other RNA
acaaagtgcttccctttagagtgt

SEQ ID NO: 581 - RNA, 22 nt, Homo sapiens
  source 1..22: mol_type = other RNA
acaaagtgcttccctttagagt

SEQ ID NO: 582 - RNA, 22 nt, Homo sapiens
  source 1..22: mol_type = other RNA
aacgcacttccctttagagtgt

SEQ ID NO: 583 - RNA, 22 nt, Homo sapiens
  source 1..22: mol_type = other RNA
aaaatggttccctttagagtgt

SEQ ID NO: 584 - RNA, 23 nt, Homo sapiens
  source 1..23: mol_type = other RNA
gaacgcgcttccctatagagggt

SEQ ID NO: 585 - RNA, 21 nt, Homo sapiens
  source 1..21: mol_type = other RNA
gaaggcgcttccctttggagt

SEQ ID NO: 586 - RNA, 22 nt, Homo sapiens
  source 1..22: mol_type = other RNA
gaaggcgcttccctttagagcg

SEQ ID NO: 587 - RNA, 21 nt, Homo sapiens
  source 1..21: mol_type = other RNA
ctccagagggatgcactttct

SEQ ID NO: 588 - RNA, 22 nt, Homo sapiens
  source 1..22: mol_type = other RNA
ctctagagggaagcactttctg

SEQ ID NO: 589 - RNA, 23 nt, Homo sapiens
  source 1..23: mol_type = other RNA
ctcttgagggaagcactttctgt

SEQ ID NO: 590 - RNA, 22 nt, Homo sapiens
  source 1..22: mol_type = other RNA
cctcccacacccaaggcttgca

SEQ ID NO: 591 - RNA, 22 nt, Homo sapiens
  source 1..22: mol_type = other RNA
catgccttgagtgtaggaccgt

SEQ ID NO: 592 - RNA, 22 nt, Homo sapiens
  source 1..22: mol_type = other RNA
atcatacaaggacaatttcttt

SEQ ID NO: 593 - RNA, 22 nt, Homo sapiens
  source 1..22: mol_type = other RNA
ggagaaattatccttggtgtgt

SEQ ID NO: 594 - RNA, 22 nt, Homo sapiens
  source 1..22: mol_type = other RNA
tggtgggcacagaatctggact

SEQ ID NO: 595 - RNA, 22 nt, Homo sapiens
  source 1..22: mol_type = other RNA
tgtgacagattgataactgaaa

SEQ ID NO: 596 - RNA, 23 nt, Homo sapiens
  source 1..23: mol_type = other RNA
tcggggatcatcatgtcacgaga

SEQ ID NO: 597 - RNA, 22 nt, Homo sapiens
  source 1..22: mol_type = other RNA
aaacattcgcggtgcacttctt

SEQ ID NO: 598 - RNA, 22 nt, Homo sapiens
  source 1..22: mol_type = other RNA
attctgcatttttagcaagttc

SEQ ID NO: 599 - RNA, 22 nt, Homo sapiens
  source 1..22: mol_type = other RNA
tcagcaaacatttattgtgtgc

SEQ ID NO: 600 - RNA, 22 nt, Homo sapiens
  source 1..22: mol_type = other RNA
caaaactggcaattacttttgc

SEQ ID NO: 601 - RNA, 22 nt, Homo sapiens
  source 1..22: mol_type = other RNA
aaaagtaattgcgagttttacc

SEQ ID NO: 602 - RNA, 25 nt, Homo sapiens
  source 1..25: mol_type = other RNA
aaaaaccacaattacttttgcacca

SEQ ID NO: 603 - RNA, 22 nt, Homo sapiens
  source 1..22: mol_type = other RNA
gaaaacgacaatgacttttgca

SEQ ID NO: 604 - RNA, 20 nt, Homo sapiens
  source 1..20: mol_type = other RNA
aaaagtgattgcagtgtttg

SEQ ID NO: 605 - RNA, 22 nt, Homo sapiens
  source 1..22: mol_type = other RNA
aaaggtaattgcagtttttccc

SEQ ID NO: 606 - RNA, 21 nt, Homo sapiens
  source 1..21: mol_type = other RNA
aaaagtaactgcggtttttga

SEQ ID NO: 607 - RNA, 22 nt, Homo sapiens
  source 1..22: mol_type = other RNA
aacggcaatgacttttgtacca

SEQ ID NO: 608 - RNA, 21 nt, Homo sapiens
  source 1..21: mol_type = other RNA
taaaactgcagttatttttgc

SEQ ID NO: 609 - RNA, 21 nt, Homo sapiens
  source 1..21: mol_type = other RNA
aaaagtaattgcagtttttgc

SEQ ID NO: 610 - RNA, 22 nt, Homo sapiens
  source 1..22: mol_type = other RNA
caagaacctcagttgcttttgt

SEQ ID NO: 611 - RNA, 22 nt, Homo sapiens
  source 1..22: mol_type = other RNA
aaaagtaattgcggtttttgcc

SEQ ID NO: 612 - RNA, 22 nt, Homo sapiens
  source 1..22: mol_type = other RNA
caaaaaccacagtttcttttgc

SEQ ID NO: 613 - RNA, 22 nt, Homo sapiens
  source 1..22: mol_type = other RNA
aaaagtaattgtggtttttgcc

SEQ ID NO: 614 - RNA, 22 nt, Homo sapiens
  source 1..22: mol_type = other RNA
aaaaactgagactacttttgca

SEQ ID NO: 615 - RNA, 22 nt, Homo sapiens
  source 1..22: mol_type = other RNA
caaaagcaatcgcggtttttgc

SEQ ID NO: 616 - RNA, 22 nt, Homo sapiens
  source 1..22: mol_type = other RNA
aaaactgtaattacttttgtac

SEQ ID NO: 617 - RNA, 22 nt, Homo sapiens
  source 1..22: mol_type = other RNA
aaaagtaatcgcggtttttgtc

SEQ ID NO: 618 - RNA, 22 nt, Homo sapiens
  source 1..22: mol_type = other RNA
aaaagtaattgcggattttgcc

SEQ ID NO: 619 - RNA, 21 nt, Homo sapiens
  source 1..21: mol_type = other RNA
caaaaactgcattacttttgc

SEQ ID NO: 620 - RNA, 22 nt, Homo sapiens
  source 1..22: mol_type = other RNA
aaaagtaattgcggtctttggt

SEQ ID NO: 621 - RNA, 22 nt, Homo sapiens
  source 1..22: mol_type = other RNA
aaaagtacttgcggattttgct

SEQ ID NO: 622 - RNA, 22 nt, Homo sapiens
  source 1..22: mol_type = other RNA
aaaagtatttgcgggttttgtc

SEQ ID NO: 623 - RNA, 21 nt, Homo sapiens
  source 1..21: mol_type = other RNA
caaaggtatttgtggtttttg

SEQ ID NO: 624 - RNA, 22 nt, Homo sapiens
  source 1..22: mol_type = other RNA
caaaagtaattgtggattttgt

SEQ ID NO: 625 - RNA, 22 nt, Homo sapiens
  source 1..22: mol_type = other RNA
ccaaaactgcagttacttttgc

SEQ ID NO: 626 - RNA, 22 nt, Homo sapiens
  source 1..22: mol_type = other RNA
gctggtgcaaaagtaatggcgg

SEQ ID NO: 627 - RNA, 22 nt, Homo sapiens
  source 1..22: mol_type = other RNA
agctacagttacttttgcacca

SEQ ID NO: 628 - RNA, 22 nt, Homo sapiens
  source 1..22: mol_type = other RNA
aaaagtaatcactgtttttgcc

SEQ ID NO: 629 - RNA, 23 nt, Homo sapiens
  source 1..23: mol_type = other RNA
caaaaaccgcaattacttttgca

SEQ ID NO: 630 - RNA, 21 nt, Homo sapiens
  source 1..21: mol_type = other RNA
tgacaactatggatgagctct

SEQ ID NO: 631 - RNA, 23 nt, Homo sapiens
  source 1..23: mol_type = other RNA
agtgcctgagggagtaagagccc

SEQ ID NO: 632 - RNA, 21 nt, Homo sapiens
  source 1..21: mol_type = other RNA
gcgacccactcttggtttcca

SEQ ID NO: 633 - RNA, 21 nt, Homo sapiens
  source 1..21: mol_type = other RNA
gcgacccatacttggtttcag

SEQ ID NO: 634 - RNA, 21 nt, Homo sapiens
  source 1..21: mol_type = other RNA
aacaggtgactggttagacaa

SEQ ID NO: 635 - RNA, 21 nt, Homo sapiens
  source 1..21: mol_type = other RNA
aaaacggtgagattttgtttt

SEQ ID NO: 636 - RNA, 21 nt, Homo sapiens
  source 1..21: mol_type = other RNA
gctagtcctgactcagccagt

SEQ ID NO: 637 - RNA, 21 nt, Homo sapiens
  source 1..21: mol_type = other RNA
agggtaagctgaacctctgat

SEQ ID NO: 638 - RNA, 22 nt, Homo sapiens
  source 1..22: mol_type = other RNA
atattaccattagctcatcttt

SEQ ID NO: 639 - RNA, 22 nt, Homo sapiens
  source 1..22: mol_type = other RNA
gatgagctcattgtaatatgag

SEQ ID NO: 640 - RNA, 22 nt, Homo sapiens
  source 1..22: mol_type = other RNA
caaagtttaagatccttgaagt

SEQ ID NO: 641 - RNA, 22 nt, Homo sapiens
  source 1..22: mol_type = other RNA
atcaaggatcttaaactttgcc

SEQ ID NO: 642 - RNA, 20 nt, Homo sapiens
  source 1..20: mol_type = other RNA
aaagtagctgtaccatttgc

SEQ ID NO: 643 - RNA, 19 nt, Homo sapiens
  source 1..19: mol_type = other RNA
aggttgacatacgtttccc

SEQ ID NO: 644 - RNA, 19 nt, Homo sapiens
  source 1..19: mol_type = other RNA
aggcacggtgtcagcaggc

SEQ ID NO: 645 - RNA, 19 nt, Homo sapiens
  source 1..19: mol_type = other RNA
gggcgcctgtgatcccaac

SEQ ID NO: 646 - RNA, 23 nt, Homo sapiens
  source 1..23: mol_type = other RNA
agtatgttcttccaggacagaac

SEQ ID NO: 647 - RNA, 20 nt, Homo sapiens
  source 1..20: mol_type = other RNA
atgtataaatgtatacacac

SEQ ID NO: 648 - RNA, 22 nt, Homo sapiens
  source 1..22: mol_type = other RNA
cgaaaacagcaattacctttgc

SEQ ID NO: 649 - RNA, 21 nt, Homo sapiens
  source 1..21: mol_type = other RNA
tgagttggccatctgagtgag

SEQ ID NO: 650 - RNA, 20 nt, Homo sapiens
  source 1..20: mol_type = other RNA
gtccgctcggcggtggccca

SEQ ID NO: 651 - RNA, 24 nt, Homo sapiens
  source 1..24: mol_type = other RNA
ctgaagtgatgtgtaactgatcag

SEQ ID NO: 652 - RNA, 22 nt, Homo sapiens
  source 1..22: mol_type = other RNA
cacgctcatgcacacacccaca

SEQ ID NO: 653 - RNA, 23 nt, Homo sapiens
  source 1..23: mol_type = other RNA
tgagtgtgtgtgtgtgagtgtgt

SEQ ID NO: 654 - RNA, 19 nt, Homo sapiens
  source 1..19: mol_type = other RNA
gagccagttggacaggagc

SEQ ID NO: 655 - RNA, 22 nt, Homo sapiens
  source 1..22: mol_type = other RNA
aagatgtggaaaaattggaatc

SEQ ID NO: 656 - RNA, 22 nt, Homo sapiens
  source 1..22: mol_type = other RNA
attctaatttctccacgtcttt

SEQ ID NO: 657 - RNA, 21 nt, Homo sapiens
  source 1..21: mol_type = other RNA
tagataaaatattggtacctg

SEQ ID NO: 658 - RNA, 21 nt, Homo sapiens
  source 1..21: mol_type = other RNA
cttcttgtgctctaggattgt

SEQ ID NO: 659 - RNA, 23 nt, Homo sapiens
  source 1..23: mol_type = other RNA
ttcatttggtataaaccgcgatt

SEQ ID NO: 660 - RNA, 22 nt, Homo sapiens
  source 1..22: mol_type = other RNA
tcgcggtttgtgccagatgacg

SEQ ID NO: 661 - RNA, 22 nt, Homo sapiens
  source 1..22: mol_type = other RNA
ttgagaatgatgaatcattagg

SEQ ID NO: 662 - RNA, 22 nt, Homo sapiens
  source 1..22: mol_type = other RNA
taactggttgaacaactgaacc

SEQ ID NO: 663 - RNA, 23 nt, Homo sapiens
  source 1..23: mol_type = other RNA
ttacagttgttcaaccagttact

SEQ ID NO: 664 - RNA, 22 nt, Homo sapiens
  source 1..22: mol_type = other RNA
tcagttccaggccaaccaggct

SEQ ID NO: 665 - RNA, 22 nt, Homo sapiens
  source 1..22: mol_type = other RNA
ttatggtttgcctgggactgag

SEQ ID NO: 666 - RNA, 19 nt, Homo sapiens
  source 1..19: mol_type = other RNA
tgggcgtatctgtatgcta

SEQ ID NO: 667 - RNA, 21 nt, Homo sapiens
  source 1..21: mol_type = other RNA
tttccataggtgatgagtcac

SEQ ID NO: 668 - RNA, 22 nt, Homo sapiens
  source 1..22: mol_type = other RNA
tgagaaccacgtctgctctgag

SEQ ID NO: 669 - RNA, 21 nt, Homo sapiens
  source 1..21: mol_type = other RNA
taattttatgtataagctagt

SEQ ID NO: 670 - RNA, 22 nt, Homo sapiens
  source 1..22: mol_type = other RNA
gagcttattcataaaagtgcag

SEQ ID NO: 671 - RNA, 20 nt, Homo sapiens
  source 1..20: mol_type = other RNA
agaccatgggttctcattgt

SEQ ID NO: 672 - RNA, 22 nt, Homo sapiens
  source 1..22: mol_type = other RNA
ttgtgtcaatatgcgatgatgt

SEQ ID NO: 673 - RNA, 19 nt, Homo sapiens
  source 1..19: mol_type = other RNA
tgtctctgctggggtttct

SEQ ID NO: 674 - RNA, 21 nt, Homo sapiens
  source 1..21: mol_type = other RNA
gaagtgtgccgtggtgtgtct

SEQ ID NO: 675 - RNA, 21 nt, Homo sapiens
  source 1..21: mol_type = other RNA
aagcctgcccggctcctcggg

SEQ ID NO: 676 - RNA, 22 nt, Homo sapiens
  source 1..22: mol_type = other RNA
tgtgtcactcgatgaccactgt

SEQ ID NO: 677 - RNA, 22 nt, Homo sapiens
  source 1..22: mol_type = other RNA
tacgtcatcgttgtcatcgtca

SEQ ID NO: 678 - RNA, 20 nt, Homo sapiens
  source 1..20: mol_type = other RNA
gttgtgtcagtttatcaaac

SEQ ID NO: 679 - RNA, 23 nt, Homo sapiens
  source 1..23: mol_type = other RNA
acttacagacaagagccttgctc

SEQ ID NO: 680 - RNA, 22 nt, Homo sapiens
  source 1..22: mol_type = other RNA
tggtctaggattgttggaggag

SEQ ID NO: 681 - RNA, 22 nt, Homo sapiens
  source 1..22: mol_type = other RNA
cacacactgcaattacttttgc

SEQ ID NO: 682 - RNA, 19 nt, Homo sapiens
  source 1..19: mol_type = other RNA
aggctgcggaattcaggac

SEQ ID NO: 683 - RNA, 23 nt, Homo sapiens
  source 1..23: mol_type = other RNA
taaatcccatggtgccttctcct

SEQ ID NO: 684 - RNA, 21 nt, Homo sapiens
  source 1..21: mol_type = other RNA
aaactactgaaaatcaaagat

SEQ ID NO: 685 - RNA, 21 nt, Homo sapiens
  source 1..21: mol_type = other RNA
gttcaaatccagatctataac

SEQ ID NO: 686 - RNA, 25 nt, Homo sapiens
  source 1..25: mol_type = other RNA
aggggtggtgttgggacagctccgt

SEQ ID NO: 687 - RNA, 21 nt, Homo sapiens
  source 1..21: mol_type = other RNA
tgagctaaatgtgtgctggga

SEQ ID NO: 688 - RNA, 25 nt, Homo sapiens
  source 1..25: mol_type = other RNA
gctgggcagggcttctgagctcctt

SEQ ID NO: 689 - RNA, 20 nt, Homo sapiens
  source 1..20: mol_type = other RNA
aggaatgttccttctttgcc

SEQ ID NO: 690 - RNA, 23 nt, Homo sapiens
  source 1..23: mol_type = other RNA
gaacgcctgttcttgccaggtgg

SEQ ID NO: 691 - RNA, 22 nt, Homo sapiens
  source 1..22: mol_type = other RNA
tccgagcctgggtctccctctt

SEQ ID NO: 692 - RNA, 22 nt, Homo sapiens
  source 1..22: mol_type = other RNA
gggggtccccggtgctcggatc

SEQ ID NO: 693 - RNA, 22 nt, Homo sapiens
  source 1..22: mol_type = other RNA
agtcattggagggtttgagcag

SEQ ID NO: 694 - RNA, 22 nt, Homo sapiens
  source 1..22: mol_type = other RNA
agacttcccatttgaaggtggc

SEQ ID NO: 695 - RNA, 24 nt, Homo sapiens
  source 1..24: mol_type = other RNA
gacctggacatgtttgtgcccagt

SEQ ID NO: 696 - RNA, 20 nt, Homo sapiens
  source 1..20: mol_type = other RNA
atggagatagatatagaaat

SEQ ID NO: 697 - RNA, 21 nt, Homo sapiens
  source 1..21: mol_type = other RNA
cacaaggtattggtattacct

SEQ ID NO: 698 - RNA, 21 nt, Homo sapiens
  source 1..21: mol_type = other RNA
agggggaaagttctatagtcc

SEQ ID NO: 699 - RNA, 19 nt, Homo sapiens
  source 1..19: mol_type = other RNA
agctgtctgaaaatgtctt

SEQ ID NO: 700 - RNA, 20 nt, Homo sapiens
  source 1..20: mol_type = other RNA
tcttttctttgagactcact

SEQ ID NO: 701 - RNA, 22 nt, Homo sapiens
  source 1..22: mol_type = other RNA
gtgagtctctaagaaaagagga

SEQ ID NO: 702 - RNA, 21 nt, Homo sapiens
  source 1..21: mol_type = other RNA
tctagtaagagtggcagtcga

SEQ ID NO: 703 - RNA, 22 nt, Homo sapiens
  source 1..22: mol_type = other RNA
atgctgacatatttactagagg

SEQ ID NO: 704 - RNA, 21 nt, Homo sapiens
  source 1..21: mol_type = other RNA
tgggtttacgttgggagaact

SEQ ID NO: 705 - RNA, 22 nt, Homo sapiens
  source 1..22: mol_type = other RNA
agtattctgtaccagggaaggt

SEQ ID NO: 706 - RNA, 21 nt, Homo sapiens
  source 1..21: mol_type = other RNA
agacctggcccagacctcagc

SEQ ID NO: 707 - RNA, 24 nt, Homo sapiens
  source 1..24: mol_type = other RNA
actgggggctttcgggctctgcgt

SEQ ID NO: 708 - RNA, 25 nt, Homo sapiens
  source 1..25: mol_type = other RNA
agggatcgcgggcgggtggcggcct

SEQ ID NO: 709 - RNA, 23 nt, Homo sapiens
  source 1..23: mol_type = other RNA
atcgctgcggttgcgagcgctgt

SEQ ID NO: 710 - RNA, 21 nt, Homo sapiens
  source 1..21: mol_type = other RNA
atgatccaggaacctgcctct

SEQ ID NO: 711 - RNA, 24 nt, Homo sapiens
  source 1..24: mol_type = other RNA
aaagacataggatagagtcacctc

SEQ ID NO: 712 - RNA, 22 nt, Homo sapiens
  source 1..22: mol_type = other RNA
agacacatttggagagggaacc

SEQ ID NO: 713 - RNA, 22 nt, Homo sapiens
  source 1..22: mol_type = other RNA
gtccctctccaaatgtgtcttg

SEQ ID NO: 714 - RNA, 22 nt, Homo sapiens
  source 1..22: mol_type = other RNA
acttgtatgctagctcaggtag

SEQ ID NO: 715 - RNA, 19 nt, Homo sapiens
  source 1..19: mol_type = other RNA
agtgtggctttcttagagc

SEQ ID NO: 716 - RNA, 19 nt, Homo sapiens
  source 1..19: mol_type = other RNA
aagtgtgcagggcactggt

SEQ ID NO: 717 - RNA, 22 nt, Homo sapiens
  source 1..22: mol_type = other RNA
aaacctgtgttgttcaagagtc

SEQ ID NO: 718 - RNA, 21 nt, Homo sapiens
  source 1..21: mol_type = other RNA
aggaggcagcgctctcaggac

SEQ ID NO: 719 - RNA, 21 nt, Homo sapiens
  source 1..21: mol_type = other RNA
gggactaggatgcagacctcc

SEQ ID NO: 720 - RNA, 23 nt, Homo sapiens
  source 1..23: mol_type = other RNA
aggtctgcattcaaatccccaga

SEQ ID NO: 721 - RNA, 22 nt, Homo sapiens
  source 1..22: mol_type = other RNA
cctcaccatcccttctgcctgc

SEQ ID NO: 722 - RNA, 23 nt, Homo sapiens
  source 1..23: mol_type = other RNA
caggcagaagtggggctgacagg

SEQ ID NO: 723 - RNA, 22 nt, Homo sapiens
  source 1..22: mol_type = other RNA
aaaggaaagtgtatcctaaaag

SEQ ID NO: 724 - RNA, 22 nt, Homo sapiens
  source 1..22: mol_type = other RNA
tttaggataagcttgacttttg

SEQ ID NO: 725 - RNA, 21 nt, Homo sapiens
  source 1..21: mol_type = other RNA
aatggcgccactagggttgtg

SEQ ID NO: 726 - RNA, 25 nt, Homo sapiens
  source 1..25: mol_type = other RNA
caaccctaggagagggtgccattca

SEQ ID NO: 727 - RNA, 22 nt, Homo sapiens
  source 1..22: mol_type = other RNA
tatgtctgctgaccatcacctt

SEQ ID NO: 728 - RNA, 22 nt, Homo sapiens
  source 1..22: mol_type = other RNA
tggtgggccgcagaacatgtgc

SEQ ID NO: 729 - RNA, 22 nt, Homo sapiens
  source 1..22: mol_type = other RNA
ataatacatggttaacctcttt

SEQ ID NO: 730 - RNA, 21 nt, Homo sapiens
  source 1..21: mol_type = other RNA
aatattatacagtcaacctct

SEQ ID NO: 731 - RNA, 21 nt, Homo sapiens
  source 1..21: mol_type = other RNA
acctcctgtgtgcatggatta

SEQ ID NO: 732 - RNA, 22 nt, Homo sapiens
  source 1..22: mol_type = other RNA
tacccattgcatatcggagttg

SEQ ID NO: 733 - RNA, 24 nt, Homo sapiens
  source 1..24: mol_type = other RNA
tgcctgggtctctggcctgcgcgt

SEQ ID NO: 734 - RNA, 22 nt, Homo sapiens
  source 1..22: mol_type = other RNA
aggcggggcgccgcgggaccgc

SEQ ID NO: 735 - RNA, 23 nt, Homo sapiens
  source 1..23: mol_type = other RNA
tattcatttatccccagcctaca

SEQ ID NO: 736 - RNA, 22 nt, Homo sapiens
  source 1..22: mol_type = other RNA
ttcatttgcctcccagcctaca

SEQ ID NO: 737 - RNA, 24 nt, Homo sapiens
  source 1..24: mol_type = other RNA
tgggctaagggagatgattgggta

SEQ ID NO: 738 - RNA, 20 nt, Homo sapiens
  source 1..20: mol_type = other RNA
accaggaggctgaggcccct

SEQ ID NO: 739 - RNA, 21 nt, Homo sapiens
  source 1..21: mol_type = other RNA
tccggttctcagggctccacc

SEQ ID NO: 740 - RNA, 23 nt, Homo sapiens
  source 1..23: mol_type = other RNA
aggaagccctggaggggctggag

SEQ ID NO: 741 - RNA, 22 nt, Homo sapiens
  source 1..22: mol_type = other RNA
cgcgcctgcaggaactggtaga

SEQ ID NO: 742 - RNA, 23 nt, Homo sapiens
  source 1..23: mol_type = other RNA
tgggcaggggcttattgtaggag

SEQ ID NO: 743 - RNA, 23 nt, Homo sapiens
  source 1..23: mol_type = other RNA
ctgggcccgcggcgggcgtgggg

SEQ ID NO: 744 - RNA, 23 nt, Homo sapiens
  source 1..23: mol_type = other RNA
tggtgcggagagggcccacagtg

SEQ ID NO: 745 - RNA, 23 nt, Homo sapiens
  source 1..23: mol_type = other RNA
aaggagcttacaatctagctggg

SEQ ID NO: 746 - RNA, 22 nt, Homo sapiens
  source 1..22: mol_type = other RNA
tgcggggctagggctaacagca

SEQ ID NO: 747 - RNA, 22 nt, Homo sapiens
  source 1..22: mol_type = other RNA
tttgtgacctggtccactaacc

SEQ ID NO: 748 - RNA, 22 nt, Homo sapiens
  source 1..22: mol_type = other RNA
gatggttgaccagagagcacac

SEQ ID NO: 749 - RNA, 23 nt, Homo sapiens
  source 1..23: mol_type = other RNA
tggaagactagtgattttgttgt

SEQ ID NO: 750 - RNA, 20 nt, Homo sapiens
  source 1..20: mol_type = other RNA
cggctctgggtctgtgggga

SEQ ID NO: 751 - RNA, 22 nt, Homo sapiens
  source 1..22: mol_type = other RNA
gcagcagggtgaaactgacaca

SEQ ID NO: 752 - RNA, 22 nt, Homo sapiens
  source 1..22: mol_type = other RNA
gcaggtgctcacttgtcctcct

SEQ ID NO: 753 - RNA, 21 nt, Homo sapiens
  source 1..21: mol_type = other RNA
tggaggagaaggaaggtgatg

SEQ ID NO: 754 - RNA, 22 nt, Homo sapiens
  source 1..22: mol_type = other RNA
actccagccccacagcctcagc

SEQ ID NO: 755 - RNA, 22 nt, Homo sapiens
  source 1..22: mol_type = other RNA
aggaggaattggtgctggtctt

SEQ ID NO: 756 - RNA, 23 nt, Homo sapiens
  source 1..23: mol_type = other RNA
tctgctcataccccatggtttct

SEQ ID NO: 757 - RNA, 23 nt, Homo sapiens
  source 1..23: mol_type = other RNA
tgcaccatggttgtctgagcatg

SEQ ID NO: 758 - RNA, 23 nt, Homo sapiens
  source 1..23: mol_type = other RNA
ctgggatctccggggtcttggtt

SEQ ID NO: 759 - RNA, 22 nt, Homo sapiens
  source 1..22: mol_type = other RNA
tgagacctctgggttctgagct

SEQ ID NO: 760 - RNA, 23 nt, Homo sapiens
  source 1..23: mol_type = other RNA
tccagtaccacgtgtcagggcca

SEQ ID NO: 761 - RNA, 23 nt, Homo sapiens
  source 1..23: mol_type = other RNA
cagtaacaaagattcatccttgt

SEQ ID NO: 762 - RNA, 22 nt, Homo sapiens
  source 1..22: mol_type = other RNA
ggagactgatgagttcccggga

SEQ ID NO: 763 - RNA, 21 nt, Homo sapiens
  source 1..21: mol_type = other RNA
gcaggaacttgtgagtctcct

SEQ ID NO: 764 - RNA, 22 nt, Homo sapiens
  source 1..22: mol_type = other RNA
ctgccctggcccgagggaccga

SEQ ID NO: 765 - RNA, 23 nt, Homo sapiens
  source 1..23: mol_type = other RNA
cggccccacgcaccagggtaaga

SEQ ID NO: 766 - RNA, 21 nt, Homo sapiens
  source 1..21: mol_type = other RNA
cctggaaacactgaggttgtg

SEQ ID NO: 767 - RNA, 22 nt, Homo sapiens
  source 1..22: mol_type = other RNA
tggtggtttacaaagtaattca

SEQ ID NO: 768 - RNA, 22 nt, Homo sapiens
  source 1..22: mol_type = other RNA
tggatttctttgtgaatcacca

SEQ ID NO: 769 - RNA, 20 nt, Homo sapiens
  source 1..20: mol_type = other RNA
gtagaggagatggcgcaggg

SEQ ID NO: 770 - RNA, 22 nt, Homo sapiens
  source 1..22: mol_type = other RNA
aggcagcggggtgtagtggata

SEQ ID NO: 771 - RNA, 22 nt, Homo sapiens
  source 1..22: mol_type = other RNA
tccattacactaccctgcctct

SEQ ID NO: 772 - RNA, 22 nt, Homo sapiens
  source 1..22: mol_type = other RNA
gtgaacgggcgccatcccgagg

SEQ ID NO: 773 - RNA, 21 nt, Homo sapiens
  source 1..21: mol_type = other RNA
cttgggagccctgttagactc

SEQ ID NO: 774 - RNA, 21 nt, Homo sapiens
  source 1..21: mol_type = other RNA
tactcaaaaagctgtcagtca

SEQ ID NO: 775 - RNA, 21 nt, Homo sapiens
  source 1..21: mol_type = other RNA
ttaatatcggacaaccattgt

SEQ ID NO: 776 - RNA, 21 nt, Homo sapiens
  source 1..21: mol_type = other RNA
tacttggaaaggcatcagttg

SEQ ID NO: 777 - RNA, 22 nt, Homo sapiens
  source 1..22: mol_type = other RNA
tgcaacgaacctgagccactga

SEQ ID NO: 778 - RNA, 22 nt, Homo sapiens
  source 1..22: mol_type = other RNA
tgcaacttacctgagtcattga

SEQ ID NO: 779 - RNA, 21 nt, Homo sapiens
  source 1..21: mol_type = other RNA
cactgtgtcctttctgcgtag

SEQ ID NO: 780 - RNA, 22 nt, Homo sapiens
  source 1..22: mol_type = other RNA
cactggctcctttctgggtaga

SEQ ID NO: 781 - RNA, 23 nt, Homo sapiens
  source 1..23: mol_type = other RNA
gcagcagagaataggactacgtc

SEQ ID NO: 782 - RNA, 20 nt, Homo sapiens
  source 1..20: mol_type = other RNA
agagtcttgtgatgtcttgc

SEQ ID NO: 783 - RNA, 23 nt, Homo sapiens
  source 1..23: mol_type = other RNA
aggttgggatcggttgcaatgct

SEQ ID NO: 784 - RNA, 22 nt, Homo sapiens
  source 1..22: mol_type = other RNA
tattgcacttgtcccggcctgt

SEQ ID NO: 785 - RNA, 22 nt, Homo sapiens
  source 1..22: mol_type = other RNA
tattgcactcgtcccggcctcc

SEQ ID NO: 786 - RNA, 22 nt, Homo sapiens
  source 1..22: mol_type = other RNA
tgtgcgcagggagacctctccc

SEQ ID NO: 787 - RNA, 22 nt, Homo sapiens
  source 1..22: mol_type = other RNA
tgtctactactggagacactgg

SEQ ID NO: 788 - RNA, 23 nt, Homo sapiens
  source 1..23: mol_type = other RNA
ccagttaccgcttccgctaccgc

SEQ ID NO: 789 - RNA, 23 nt, Homo sapiens
  source 1..23: mol_type = other RNA
caaagtgctgttcgtgcaggtag

SEQ ID NO: 790 - RNA, 22 nt, Homo sapiens
  source 1..22: mol_type = other RNA
acagtagagggaggaatcgcag

SEQ ID NO: 791 - RNA, 22 nt, Homo sapiens
  source 1..22: mol_type = other RNA
atccgcgctctgactctctgcc

SEQ ID NO: 792 - RNA, 24 nt, Homo sapiens
  source 1..24: mol_type = other RNA
tggggagctgaggctctgggggtg

SEQ ID NO: 793 - RNA, 21 nt, Homo sapiens
  source 1..21: mol_type = other RNA
aaggcagggcccccgctcccc

SEQ ID NO: 794 - RNA, 23 nt, Homo sapiens
  source 1..23: mol_type = other RNA
cacccggctgtgtgcacatgtgc

SEQ ID NO: 795 - RNA, 22 nt, Homo sapiens
  source 1..22: mol_type = other RNA
cacatggccgaaacagagaagt

SEQ ID NO: 796 - RNA, 22 nt, Homo sapiens
  source 1..22: mol_type = other RNA
tcttctctgttttggccatgtg

SEQ ID NO: 797 - RNA, 22 nt, Homo sapiens
  source 1..22: mol_type = other RNA
aaattattgtacatcggatgag

SEQ ID NO: 798 - RNA, 22 nt, Homo sapiens
  source 1..22: mol_type = other RNA
ttcaacgggtatttattgagca

SEQ ID NO: 799 - RNA, 23 nt, Homo sapiens
  source 1..23: mol_type = other RNA
tttggcactagcacatttttgct

SEQ ID NO: 800 - RNA, 22 nt, Homo sapiens
  source 1..22: mol_type = other RNA
ctatacaacttactactttccc

SEQ ID NO: 801 - RNA, 22 nt, Homo sapiens
  source 1..22: mol_type = other RNA
tgaggtagtaagttgtattgtt

SEQ ID NO: 802 - RNA, 22 nt, Homo sapiens
  source 1..22: mol_type = other RNA
aacccgtagatccgatcttgtg

SEQ ID NO: 803 - RNA, 22 nt, Homo sapiens
  source 1..22: mol_type = other RNA
cacccgtagaaccgaccttgcg

SEQ ID NO: 804 - DNA, 22 bp, Homo sapiens
  source 1..22: mol_type = other DNA
caaacaccattgtcacactcca

SEQ ID NO: 805 - DNA, 20 bp, Homo sapiens
  source 1..20: mol_type = other DNA
ggcattcaccgcgtgcctta

SEQ ID NO: 806 - DNA, 24 bp, Homo sapiens
  source 1..24: mol_type = other DNA
tcacaggttaaagggtctcaggga

SEQ ID NO: 807 - DNA, 22 bp, Homo sapiens
  source 1..22: mol_type = other DNA
cgcattattactcacggtacga

SEQ ID NO: 808 - DNA, 22 bp, Homo sapiens
  source 1..22: mol_type = other DNA
cacattattactcacggtacga

SEQ ID NO: 809 - DNA, 22 bp, Homo sapiens
  source 1..22: mol_type = other DNA
agccaagctcagacggatccga

SEQ ID NO: 810 - DNA, 21 bp, Homo sapiens
  source 1..21: mol_type = other DNA
aaagagaccggttcactgtga

SEQ ID NO: 811 - DNA, 21 bp, Homo sapiens
  source 1..21: mol_type = other DNA
aaagagaccggttcactgtgg

SEQ ID NO: 812 - DNA, 22 bp, Homo sapiens
  source 1..22: mol_type = other DNA
atactttttggggtaagggctt

SEQ ID NO: 813 - DNA, 21 bp, Homo sapiens
  source 1..21: mol_type = other DNA
gcaagcccagaccgcaaaaag

SEQ ID NO: 814 - DNA, 22 bp, Homo sapiens
  source 1..22: mol_type = other DNA
atgccctttcatcattgcactg

SEQ ID NO: 815 - DNA, 21 bp, Homo sapiens
  source 1..21: mol_type = other DNA
gtagtgcaacagggaaagagt

SEQ ID NO: 816 - DNA, 22 bp, Homo sapiens
  source 1..22: mol_type = other DNA
cagctggttgaaggggaccaaa

SEQ ID NO: 817 - DNA, 22 bp, Homo sapiens
  source 1..22: mol_type = other DNA
tagctggttgaaggggaccaaa

SEQ ID NO: 818 - DNA, 23 bp, Homo sapiens
  source 1..23: mol_type = other DNA
ttggtgactaggtggcccacagg

SEQ ID NO: 819 - DNA, 23 bp, Homo sapiens
  source 1..23: mol_type = other DNA
ctacgcgtattcttaagcaataa

SEQ ID NO: 820 - DNA, 22 bp, Homo sapiens
  source 1..22: mol_type = other DNA
atacatacttctttacattcca

SEQ ID NO: 821 - DNA, 21 bp, Homo sapiens
  source 1..21: mol_type = other DNA
gagctacagtgcttcatctca

SEQ ID NO: 822 - DNA, 22 bp, Homo sapiens
  source 1..22: mol_type = other DNA
agaacagtatttccaggaatcc

SEQ ID NO: 823 - DNA, 23 bp, Homo sapiens
  source 1..23: mol_type = other DNA
agggattcctgggaaaactggac

SEQ ID NO: 824 - DNA, 22 bp, Homo sapiens
  source 1..22: mol_type = other DNA
acccttatcagttctccgtcca

SEQ ID NO: 825 - DNA, 22 bp, Homo sapiens
  source 1..22: mol_type = other DNA
taaccaatgtgcagactactgt

SEQ ID NO: 826 - DNA, 23 bp, Homo sapiens
  source 1..23: mol_type = other DNA
gaacaggtagtctgaacactggg

SEQ ID NO: 827 - DNA, 22 bp, Homo sapiens
  source 1..22: mol_type = other DNA
aggcataggatgacaaagggaa

SEQ ID NO: 828 - DNA, 22 bp, Homo sapiens
  source 1..22: mol_type = other DNA
acaaaccttttgttcgtcttat

SEQ ID NO: 829 - DNA, 22 bp, Homo sapiens
  source 1..22: mol_type = other DNA
actgcctgtctgtgcctgctgt

SEQ ID NO: 830 - DNA, 23 bp, Homo sapiens
  source 1..23: mol_type = other DNA
tccaatcagttcctgatgcagta

SEQ ID NO: 831 - DNA, 21 bp, Homo sapiens
  source 1..21: mol_type = other DNA
agaattgcgtttggacaatca

SEQ ID NO: 832 - DNA, 22 bp, Homo sapiens
  source 1..22: mol_type = other DNA
tggggtatttgacaaactgaca

SEQ ID NO: 833 - DNA, 22 bp, Homo sapiens
  source 1..22: mol_type = other DNA
acaaccagctaagacactgcca

SEQ ID NO: 834 - DNA, 22 bp, Homo sapiens
  source 1..22: mol_type = other DNA
aactcagtaatggtaacggttt

SEQ ID NO: 835 - DNA, 21 bp, Homo sapiens
  source 1..21: mol_type = other DNA
ttttggtgcatatttacttta

SEQ ID NO: 836 - DNA, 22 bp, Homo sapiens
  source 1..22: mol_type = other DNA
aactatacaacctactacctca

SEQ ID NO: 837 - DNA, 23 bp, Homo sapiens
  source 1..23: mol_type = other DNA
tcatacagctagataaccaaaga

SEQ ID NO: 838 - protein, 9 aa, synthetic construct
  REGION 1..9: note = mutated viral glycoprotein gB:D285
  VARIANT 5: note = X can be any naturally occurring amino acid
VYPYXEFVL

SEQ ID NO: 839 - protein, 9 aa, synthetic construct
  REGION 1..9: note = mutated viral glycoprotein gB:A549
  VARIANT 6: note = X can be any naturally occurring amino acid
KLNPNXIAS

SEQ ID NO: 840 - protein, 9 aa, synthetic construct
  REGION 1..9: note = mutated viral glycoprotein gB:S668
  VARIANT 5: note = X can be any naturally occurring amino acid
ITTVXTFID

SEQ ID NO: 841 - protein, 9 aa, synthetic construct
  REGION 1..9: note = mutated viral glycoprotein gH:N753
  VARIANT 5: note = X can be any naturally occurring amino acid
VDTDXTQQQ

SEQ ID NO: 842 - protein, 9 aa, synthetic construct
  REGION 1..9: note = mutated viral glycoprotein gH:A778
  VARIANT 5: note = X can be any naturally occurring amino acid
VPSTXLLLF

SEQ ID NO: 843 - DNA, 32767 bp, synthetic construct
  misc_feature 1..32767: note = recombinant viral vector ONCR-131
  source 1..32767: mol_type = other DNA
aaaaaagctgaacgagaaacgtaaaatgatataaatatcaatatattaaattagattttgcataaaaaacagactacataatactgtaaaacacaacatatccagtcactatgaatcaactacttagatggtattagtgacctgtagtcgaccgacagccttccaaatgttcttcgggtgatgctgccaacttagtcgaccgacagccttccaaatgttcttctcaaacggaatcgtcgtatccagcctactcgctattgtcctcaatgccgtattaaatcataaaaagaaataagaaaaagaggtgcgagcctcttttttgtgtgacaaaataaaaacatctacctattcatatacgctagtgtcatagtcctgaaaatcatctgcatcaagaacaatttcacaactcttatacttttctcttacaagtcgttcggcttcatctggattttcagcctctatacttactaaacgtgataaagtttctgtaatttctactgtatcgacctgcagactggctgtgtataagggagcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgcccgggcgtgtcaataatatcactctgtacatccacaaacagacgataacggctctctcttttataggtgtaaaccttaaactgcatttcaccagcccctgttctcgtcagcaaaagagccgttcatttcaataaaccgggcgacctcagccatcccttcctgattttccgctttccagcgttcggcacgcagacgacgggcttcattctgcatggttgtgcttaccagaccggagatattgacatcatatatgccttgagcaactgatagctgtcgctgtcaactgtcactgtaatacgctgcttcatagcatacctctttttgacatacttcgggtatacatatcagtatatattcttataccgcaaaaatcagcgcgcaaatacgcatactgttatctggcttttagtaagccggatccacgcggcgtttacgccccccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttagtcgactacaggtcactaataccatctaagtagttgattcatagtgactggatatgttgtgttttacagtattatgtagtctgttttttatgcaaaatctaatttaatatattgatatttatatcattttacgtttctcgttcagctttcttgtacaaagtggttttaatggaccgcccgcaagggggggggggcatttcagtgtcgggtgacgagcgcgatccggccgggatcctaggaccccaaaagtttgtctgcgtattccagggcggggctcagttgaatctcccgcagcacctctaccagcaggtccgcggtgggctggagaaactcggccgtcccggggcaggcggttgtcgggggtggaggcgcggcgcccaccccgtgtgccgcgcctggcgtctcctctgggggcgacccgtaaatggttgcagtgatgtaaatggtgtccgcggtccagaccacggtcaaaatgccggccgtggcgctccgggcgctttcgccgcgcgaggagctgacccaggagtcgaacggatacgcgtacatatgggcgtcccacccgcgttcgagcttctggttgctgtcccggcctataaagcggtaggcacaaaattcggcgcgacagtcgataatcaccaacagcccaatgggggtgtgctggataacaacgcctccgcgcggcaggcggtcctggcgctcccggccccgtaccatgatcgcgcgggtgccgtactcaaaaacatgcaccacctgcgcggcgtcgggcagtgcgctggtcagcgaggccctggcgtggcataggctatacgcgatggtcgtctgtggattggacatctcgcggtgggtagtgagtcccccgggccgggttcggtggaactgtaaggggacggcgggttaatagacaatgaccacgttcggatcgcgcagagccgatagtatgtgctcactaatgacgtcatcgcgctcgtggcgctcccggagcggatttaagttcatgcgaaggaattcggaggaggtggtgcgggacatggccacgtacgcgctgttgaggcgcaggttgccgggcgtaaagcagatggcgaccttgtccaggctaaggccctgggagcgcgtgatggtcatggcaagcttggagctgatgccgtagtcggcgtttatggccatggccagctccgtagagtcaatggactcgacaaactcgctgatgttggtgttgacgacggacatgaagccgtgttggtcccgcaagaccacgtaaggcaggggggcctcttccagtaactcggccacgttggccgtcgcgtgccgcctccgcagctcgtccgcaaaggcaaacacccgtgcgtacgtgtatcccatgagcgtataattgtccgtctgcagggcgacggacatcagccccccgcgcggcgagccggtcagcatctcgcagccccggaagataacgttgtccacgtacgtgctaaagggggcgacttcaaatgcctccccgaagagctcttggaggattcggaatctcccgaggaaggcccgcttcagcagcgcaaactgggtgtgaacggcggcggtggtctccggttccccgggggtgtagtggcagtaaaacacgtcgagctgttgttcgtccagccccgcgaaaataacgtcgaggtcgtcgtcgggaaaatcgtccgggcccccgtcccgcggccccagttgcttaaaatcaaacgcacgctcgccgggggcgcctgcgtcggccattaccgacgcctgcgtcggcacccccgaagatttggggcgcagagacagaatctccgccgttagttctcccatgcgggcgtaggcgagggtcctctgggtcgcatccaggcccgggcgctgcagaaagttgtaaaaggagataagcccgctaaatatgagccgcgacaggaacctgtaggcaaactccaccgaagtctccccctgagtctttacaaagctgtcgtcacgcaacactgcctcgaaggcccggaacgtcccactaaacccaaaaaccagttttcgcaggcgcgcggtcaccgcgatctggctgttgaggacgtaagtgacgtcgttgcgggccacgaccagctgctgtttgctgtgcacctcgcagcgcatgtgccccgcgtcctggtcctggctctgcgagtagttggtgatgcggctggcgttggccgtgagccacttttcaatcgtcaggccgggctggtgtgtcagccgtcggtattcgtcaaactccttgaccgacacgaacgtaagcacggggagggtgaacacgacgaactccccctcacgggtcaccttcaggtaggcgtggagcttggccatgtacgcgctcacctctttgtgggaggagaacagccgcgtccagccggggaggttggcggggttggtgatgtagttttccgggacgacgaagcgatccacgaactgcatgtgctcctcggtgatgggcaggccgtactccagcaccttcatgaggttaccgaactcgtgctcgacgcaccgtttgttgttaataaaaatggcccagctatacgagaggcgggcgtactcgcgcagcgtgcggttgcagatgaggtacgtgagcacgttctcgctctggcggacggaacaccgcagtttctggtgctcgaaggtcgactccagggacgccgtctgcgtcggcgagcccacacacaccaacacgggccgcaggcgggccgcgtactggggggtgtggtacagggcgttaatcatccaccagcaatacaccacggccgtgaggaggtgacgcccaaggagcccggcctcgtcgatgacgatcacgttgctgcgggtaaaggccggcagcgccccgtgggtggccggggccaaccgcgtcagggcgccctcggccaaccccagggtccgttccagggcggccagggcgcgaaactcgttccgcaactcctcgcccccggaggcggccagggcgcgcttcgtgaggtccaaaatcacctcccagtagtacgtcagatctcgtcgctgcaggtcctccagcgaggcggggttgctggtcagggtgtacgggtactgtcccagttgggcctggacgtgattcccgcgaaacccaaattcatgaaagatggtgttgatgggtcggctgagaaaggcgcccgagagtttggcgtacatgttttgggccgcaatgcgcgtggcgcccgtcaccacacagtccaagacctcgttgattgtctgcacgcacgtgctctttccggagccagcgttgccggtgataagatacaccgcgaacggaaactccctgaggggcaggcctgcgggggactctaaggccgccacgtcccggaaccactgcagatggggcacttgcgctccgtcgagctgttgttgcgagagctctcggatgcgcttaaggattggctgcaccccgtgcatagacgtaaaatttaaaaaggcctcggccctccctggaacggctggtcggtccccgggttgctgaaggtgcggcgggccgggtttctgtccgtctagctggcgctccccgccggccgccgccatgaccgcaccacgctcgcgggcccccactacgcgtgcgcggggggacacggaagcgctgtgctcccccgaggacggctgggtaaaggttcaccccagccccggtacgatgctgttccgcgagattctccacgggcagctggggtataccgagggccagggggtgtacaacgtcgtccggtccagcgaggcgaccacccggcagctgcaggcggcgatctttcacgcgctcctcaacgccaccacttaccgggacctcgaggcggactggctcggccacgtggcggcccgcggtctgcagccccaacggctggttcgccggtacaggaacgcccgggaggcggatatcgccggggtggccgagcgggtgttcgacacgtggcggaacacgcttaggacgacgctgctggactttgcccacgggttggtcgcctgctttgcgccgggcggcccgagcggcccgtcaagcttccccaaatatatcgactggctgacgtgcctggggctggtccccatattacgcaagcgacaagaagggggtgtgacgcagggtctgagggcgtttctcaagcagcacccgctgacccgccagctggccacggtcgcggaggccgcggagcgcgccggccccgggttttttgagctggcgctggccttcgactccacgcgcgtggcggactacgaccgcgtgtatatctactacaaccaccgccggggcgactggctcgtgcgagaccccatcagcgggcagcgcggagaatgtctggtgctgtggccccccttgtggaccggggaccgtctggtcttcgattcgcccgtccagcggctgtttcccgagatcgtcgcgtgtcactccctccgggaacacgcgcacgtctgccggctgcgcaataccgcgtccgtcaaggtgctgctggggcgcaagagcgacagcgagcgcggggtggccggtgccgcgcgggtcgttaacaaggtgttgggggaggacgacgagaccaaggccgggtcggccgcctcgcgcctcgtgcggcttatcatcaacatgaagggcatgcgccacgtaggcgacattaacgacaccgtgcgttcctacctcgacgaggccggggggcacctgatagacgccccggccgtcgacggtaccctccctggattcggcaagggcggaaacagccgcgggtctgcgggccaggaccagggggggcgggcgccgcagcttcgccaggccttccgcacggccgtggttaacaacatcaacggcgtgttggagggctatataaataacctgtttggaaccatcgagcgcctgcgcgagaccaacgcgggcctggcgacccaattgcaggagcgcgaccgcgagctccggcgcgcaacagcgggggccctggagcgccagcagcgcgcggccgacctggcggccgagtccgtgaccggtggatgcggcagccgccctgcgggggcggacctgctccgggccgactatgacattatcgacgtcagcaagtccatggacgacgacacgtacgtcgccaacagctttcagcacccgtacatcccttcgtacgcccaggacctggagcgcctgtcgcgcctctgggagcacgagctggtgcgctgttttaaaattctgtgtcaccgcaacaaccagggccaagagacgtcgatctcgtactccagcggggcgatcgccgcattcgtcgccccctactttgagtcagtgcttcgggccccccgggtaggcgcgcccatcacgggctccgatgtcatcctgggggaggaggagttatgggatgcggtgtttaagaaaacccgcctgcaaacgtacctgacagacatcgcggccctgttcgtcgcggacgtccagcacgcagcgctgcccccgcccccctccccggtcggcgccgatttccggcccggcgcgtccccgcggggccggtccagatcgcggtcgcccggaagaactgcgcgaggcgcgccggaccagggcgggggcatcgggcaccgggatggccgccgcgacggccgacgatgaggggtcggccgccaccatcctcaagcaggccatcgccggggaccgcagcctggtcgaggcggccgaggcgattagccagcagacgctgctccgcctggcctgcgaggtgcgccaggtcggcgaccgccagccgcggtttaccgccaccagcatcgcgcgcgtcgacgtcgcgcctgggtgccggttgcggttcgttctggacgggagtcccgaggacgcctatgtgacgtcggaggattactttaagcgctgctgcggccagtccagttatcgcggcttcgcggtggcggtcctgacggccaacgaggaccacgtgcacagcctggccgtgccccccctcgttctgctgcaccggttctccctgttcaaccccagggacctcctggactttgagcttgcctgtctgctgatgtacctggagaactgcccccgaagccacgccaccccgtcgacctttgccaaggttctggcgtggctcggggtcgcgggtcgccgcacgtccccattcgaacgcgttcgctgccttttcctccgcagttgccactgggtcctaaacacactcatgttcatggtgtacgtaaaaccgttcgacgacgagttcgtcctgccccactggtacatggcccggtacctgctggccaacaacccgccccccgttctctcggccctgttctgtgccaccccgacgagctcctcattccggctgccggggccgcccccccgctccgactgcgtggcctataaccccgccgggatcatggggagctgctgggcgtcggaggaggtgcgcgcgcctctggtctattggtggctttcggagaccccaaaacgacagacgtcgtcgctgttttatcagttttgttgaattttaggaaataaacccggttttgtttctgtggcctcccgacggatgcgcgtgtccttactccgtcttggtgggtgggtggctgtgtatggcgtcccatctgtgcggggaggggggcaagtcggcacgtattcggacagactcaagcacataagacgaacaaaaggtttgtaacttcgtaccgtgagtaataatgtggactttattgcttaagaatacgcgtagagaaataagacgaacaaaaggtttgtgattttattgcttaagaatacgcgtagatggtcgtaccgtgagtaataatgtggttcataagacgaacaaaaggtttgtgacattattgcttaagaatacgcgtaggtggtcgtaccgtgagtaataatgtgtactttattgcttaagaatacgcgtaggctatcgtaccgtgagtaataatgtgccttataagacgaacaaaaggtttgtacacgggggagcgctcttgtctcagggcaatgtttttattggtcaaactcaggcaaacagaaacgacatcttgtcgtcaaagggatacacaaacttccccccctcgccccatactcccgccagcaccccggtaaacaccaactcaatctcgcgcaggatttcgcgcaggtgatgagcgcagtccacgggggggagcacaaggggccgcgggtatagatcgacggggacgccgaccgactccccgcctccgggacagacacgcacgacgcgccgccagtagtgctctgcgtccagcaaggcgccgccgcggaaggcagtggggggcaaggggtcgctggcctcaaagggggacacccgaacgctccagtactccgcgtccaaccgtttattaaacgcgtccaagataaggcggtcgcaggcgtcctccataaggccccgggccgtgagtgcgtcctcctccggcacgcatgccgttgtcaggcccaggacccgtcgcagcgtgtcgcgtacgacccctgccgccgtggtgtacgcgggcccgcggagaggaaatcccccaagatggtcagtgttgtcgcgggagttccagaaccacactcccgcctggctccaggcgactgcgtgggtgtagacgccctcgagggccaggcacagtgggtgccgcagccggacggcgttggccctaagcacggctcccacggccgtctcgatggcccgccgggcgtcctcgatcaccccggaagccgcatccgcgtcttgggggtccacgttaaagacaccccagaacgcacccccatcgcccccgcagaccgcgaacttcaccgagctggccgtctcctcgatctgcaggcagacggcggccattaccccacccaggagctgccgcagcgcagggcaggcgttgcacgtgtccgggaccaggcgctccaagacggccccggcccagggctctgagggagcggccaccaccagcgcgtccagtcttgctaggcccgtccggccgtgggggtccgccagcccgctccccccgaggtcggccagggccgccaggagctgggcgcgaagtccggggaagcaaaaccgcgccgtccagacgggcccgacggccgcgggcgggtctaacagttggatgattttagtggcgggatgccaccgcgccaccgcctcccgcaccgcgggcaggaggcatccggctgccgccgaggccacgccgggccaggctcgcggggggaggacgaccctggcccccaccgcgggccaggcccccaggagcgcggcgtaagcggccgcggccccgcgcaccaggtcccgtgccgactcggccgtggccggcacggtgaacgtgggccaacccggaaaccccaggacggcaaagtacgggacgggtcccccccggacctcaaactcgggccccagaaaggcaaagacgggggccagggccccgggggcggcgtggaccgtggtatgccactgccggaaaagggcgacgagcgccggcgcggagaacttctcgccggcgcttacaaagtagtcgtaatcgcggggcagcagcacccgtgccgtgactcgttgcgggtgcccgcgtggccgcaggcccacctcgcacacctcgaccaggtccccgaacgcgccctccttcttgatcggcggaaacgcaagagtctggtattcgcgcgcaaatagcgcggttccggtggtgatgttaacggtcagcgaagcggcggacgcgcactggggggtgtcgcgaatggccgccaggcgcgcccacgccagccgcgcgtcgggatgctcggcaacgcgcgccgccagggccatagggtcgatgtcaatgttggcctccgcgaccaggagagcggcgcgaggggcggcgggcgggccccacgacgctctctcaactttcaccaccagtcccgtgcgtgggtccgagccgatacgcagcggggcgaacagggccaccggcccggtctggcgctccagggccgccaggacgcacgcgtacagcgcccgccacagagtcgggttctccaggggctccagcggggaggcggccggcgtcgtcgcggcgcgggcggccgccacgacggcctggacggagacgtccgcggagccgtagaaatcccgcagctccgtcgcggtgacggagacctccgcaaagcgcgcgcgaccctcccctgcggcgttgcgacatacaaaatacaccagggcgtggaagtactcgcgagcgcgggggggcagccataccgcgtaaagggtaatggcgctgacgctctcctccacccacacgatatctgcggtgtccatcgcacggcccctaaggatcacgggcggtctgtgggtcccatgctgccgtgcctggccgggcccggtgggtcgcggaaaccggtgacggggggggggcggtttttggggttggggtgggggtgggaaacggcccgggtccgggggccaacttggcccctcggtgcgttccggcaacagcgccgccggtccgcggacgaccacgtaccgaacgagtgcggtcccgagacttatagggtgctaaagttcaccgccccctgcatcatgggccaggcctcggtggggagctccgacagcgccgcctccaggatgatgtcagcgttggggttggcgctggatgagtgcgtgcgcaaacagcgcccccacgcgggcacgcgtagcttgaagcgcgcgcccgcaaactcccgcttgtgggccataagcagggcgtacagctgcctgtgggtccggcaggcgctgtggtcgatgtggtgggcgtccaacaaccccacgattgtctgtttggtgaggtttttaacgcgccccgccccgggaaacgtctgcgtgcttttggccatctgcacgccaaacagttcgccccagattatcttgaacagcgccaccgcgtggtccgtctcgctaacggacccgcgcgggggacagccgcttagggcgtcggcgacgcgcttgacggcttcctccgagagcagaagtccgtcggttacgttacagtggcccagttcgaacaccagctgcatgtagcggtcgtagtggggggtcagtaggtccagcacgtcatcggggccgaaggtcctcccagatcccccggccgccgagtcccaatgcaggcgcgcggccatggtgctgcacaggcacaacagctcccagacgggggttacgttcagggtggggggcagggccacgagctccagctctccggtgacgttgatcgtggggatgacgcccgtggcgtagtggtcatagatccgccgaaatatggcgctgctgcgggtggccatgggaacgcggagacaggcctccagcaacgccaggtaaataaaccgcgtgcgtcccatcaggctgttgaggttgcgcatgagcgcgacaatttccgccggcgcgacatcggaccggaggtatttttcgacgaaaagacccacctcctccgtctcggcggcctgggccggcagcgacgcctcgggatcccggcaccgcagctcccgtagatcgcgctgggccctgagggcgtcgaaatgtacgccccgcaaaaacagacagaagtcctttggggtcagggtatcgtcgtgtccccagaagcgcacgcgtatgcagtttagggtcagcagcatgtgaaggatgttaaggctgtccgagagacacgccagcgtgcatctctcaaagtagtgtttgtaacggaatttgttgtagatgcgcgacccccgccccagcgacgtgtcgcatgccgacgcgtcacagcgccccttgaaccggcgacacagcaggtttgtgacctgggagaactgcgcgggccactggccgcaggaactgaccacgtgattaaggagcatgggcgtaaagacgggctccgagcgcgccccggagccgtccatgtaaatcagtagctcccccttgcggagggtgcgcacccgtcccagggactggtacacggacaccatgtccggtccgtagttcatgggtttcacgtaggcgaacatgccatcaaagtgcaggggatcgaagctgaggcccacggttacgaccgtcgtgtatataaccacgcggtattggccccacgtggtcacgtccccgaggggggtgagcgagtgaagcaacagcacgcggtccgtaaactgacggcagaaccgggccacgatctccgcgaaggagaccgtcgacgaaaaaatgcagatgttatcgcccccgccaaggcgcgcttccagctccccaaagaacgtggccccccgggcctccggagaggcgtccggagacgggccgctcggcggcccgggcgggcgcagggcagcctgcaggagctcggtccccagacgcgggagaaacaggcaccggcgcgccgaaaacccgggcatggcgtactcgccgaccaccacatgcacgtttttttcgccccggagaccgcacaggaagtccaccaactgcgcgttggcggttgcgtccatggcgatgatccgaggacagatgcgcagcaggcgtagcattaacgcatccacgcggcccagttgctgcatcgttggcgaatagagctggcccagcgtcgacataacctcgtccagaacgaggacgtcgtagttgttcagaaggttggggcccacgcgatgaaggctttccacctggacgataagtcggtggaaggggcggtcgttcataatgtaattggtggatgagaagtaggtgacaaagtcgaccaggcctgactcagcgaaccgcgtcgctagggtctgggtaaaactccgacgacaggagacgacgagcacactcgtgtccggagagtggatcgcttcccgcagccagcggatcagcgcggtagtttttcccgaccccattggcgcgcggaccacagtcacgcacctggccgtcggggcgctcgcgttggggaaggtgacgggtccgtgctgctgccgctcgatcgttgttttcgggtgaacccggggcacccattcggccaaatcccccccgtacaacatccgcgctagcgatacgctcgacgtgtactgttcgcactcgtcgtccccaatgggacgcccggcccccagaggatctcccgactccgcgccccccacgaaaggcatgaccggggcgcggacggcgtggtgggtctggtgtgtgcaggtggcgacgtttgtggtctctgcggtctgcgtcacggggctcctcgtcctggcctctgtgttccgggcacggtttccctgcttttacgccacggcgagctcttatgccggggtgaactccacggccgaggtgcgcgggggtgtagccgtgcccctcaggttggacacgcagagccttgtgggcacttatgtaatcacggccgtgttgttgttggccgtggccgtgtatgccgtggtcggcgccgtgacctcccgctacgaccgcgccctggacgcgggccgccgtctggctgcggcccgcatggccatgccgcacgccacgctgatcgccggaaacgtctgctcttggttgctgcagatcaccgtcctgttgctggcccatcgcatcagccagctggcccacctggtttacgtcctgcactttgcgtgtctggtgtattttgcggcccatttttgcaccaggggggtcctgagcgggacgtatctgcgtcaggtgcacggcctgatggagctggccccgacccatcatcgcgtcgtcggcccggctcgcgccgtgctgacaaacgccttgctgttgggcgtcttcctgtgcacggccgacgccgcggtatccctgaataccatcgccgcgttcaactttaatttttcggccccgggcatgctcatctgcctgaccgtgctgttcgccattctcgtcgtatcgctgttgttggtggtcgagggggtgttgtgtcactacgtgcgcgtgttggtgggcccccacctgggggccgtggccgccacgggcatcgtcggcctggcctgcgagcactattacaccaacggctactacgttgtggagacgcagtggccgggggctcagacgggagtccgcgtcgccctcgccctggtcgccgcctttgccctcggcatggccgtgctccgctgcacccgcgcctatctgtatcacaggcggcaccacaccaaattttttatgcgcatgcgcgacacgcgacaccgcgcacattccgccctcaagcgcgtacgcagttccatgcgcggatcgcgagacggccgccacaggcccgcacccggcagcccgcccgggattcccgaatatgcggaagacccctacgcgatctcatacggcggccagctcgaccggtacggagattccgacggggagccgatttacgacgaggtggcggacgaccaaaccgacgtattgtacgccaagatacaacacccgcggcacctgcccgacgacgatcccatctatgacaccgttggggggtacgaccccgagcccgccgaggaccccgtgtacagcaccgtccgccgttggtagctgtttggttccgttttaataaaccgtttgtgtttaacccgaccgtggtgtatgtctggtgtgtggcgtccgatcccgttactatcaccgtccccccccccccctcaaccccggcgattgtgggttttttaaaaacgacacgcgtgcgaccgtatacagaacattgttttggtttttattcgctatcggacatggggggtggaaactgggtggcggggcaggcgcctccgggggtccgccggtgagtgtggcgcgagggggggtccgatgaacgcaggcgctgtctccccggggcccgcgtaaccccgcgcatatccgggggcacgtagaaattaccttcctcttcggactcgatatccacgacgtcaaagtcgtgggcggtcagcgagacgacctccccgtcgtcggtgatgaggacgttgtttcggcagcagcagggccgggccccggagaacgagaggcccatagctcggcgagcgtgtcgtcgaatgccaggcggctgcttcgctggatggccttatagatctccggatcgatgcggacgggggtaatgatcagggcgatcggaacggcctggttcgggagaatggacgccttgctgggtcctgcggccccgagagccccggcgccgtcctccaggcggaacgttacgccctcctccgcgctggtgcggtgcctgccgataaacgtcaccagatgcgggtggggggggcagtcggggaagtggctgtcgagcacgtagccctgcaccaagatctgcttaaagttcgggtgacgggggttcgcgaagacgggctcgcggcggaccagatccccggagctccaggacacgggggagatggtgtggcgtccgaggtcgggggcgccaaacagaagcacctccgagacaacgccgctatttaactccaccaaggcccgatccgcggcggagcaccgccttttttcgcccgaggcgtgggcctctgaccaggcctggtcttgcgtgacgagagcctcctccgggccggggacgcgcccgggcgcgaagtatcgcacgctgggcttcgggatcgaccggataaatgcccggaacgcctccggggaccggtgtgccatcaagtcctcgtacgcggaggccgtggggtcgctggggtccatggggtcgaaagcgtacttggcccggcatttgacctcgtaaaaggccaggggggtcttggggactggggccaggtagccgtgaatgtcccgaggacagacgagaatatccagggacgccccgaccatccccgtgtgaccgtccatgaggaccccacacgtatgcacgttctcttcggcgaggtcgctgggttcgtggaagataaagcgccgcgtgtcggcgccggcctcgccgccgtcgtccgcgcggcccacgcagtagcgaaacagcaggcttcgggccgtcggctcgttcacccgcccgaacatcaccgccgaagactgtacatccggccgcaggctggcgttgtgcttcagccactggggcgagaaacacggaccctgggggccccagcggagggtggatgcggtcgtgaggccccgccggagcagggcccatagctggcagtcggcctggttttgcgtggccgcctcgtaaaaccccatgaggggccggggcgccacggcgtccgcggcggccgggggcccgcggcgcgtcaggcgccataggtgccgaccgagtccgcggtccaccatacccgcctcctcgaggaccacggccagggaacacagataatccaggcgggcccagaggggaccgatggccagaggggcgcggacgccgcgcagcaacccgcgcaggtggcgctcgaacgtctcggctagtatatgggagggcagcgcgttggggatcaccgacgccgaccacatagagtcaaggtccggggagtcgggatcggcgtccgggtcgcgggcgtgggtgcccccaggagatagcggaatgtctggggtcggaggccctgaggcgtcagaaagtgccggcgacgcggcccggggcttttcgtctgcggtgtcggtggcgtgctgatcacgtggggggttaacgggcgaatgggagctcgggtccacagctgatgtcgtctggggtggggggggcaggggacggaaggtggttgtcagcggaagactgttagggcgggggcgcttgggggggctgtcggggccacgaggggtgtcctcggccagggcccagggacgcttagtcacggtgcgtcccggcggacatgctgggcctaccgtggactccatttccgagacgacgtggggggagcggtggttgagcgcgccgccgggtgaacgctgattctcacgacagcgcgtgccgcgcgcacgggttggtgtgacacaggcgggacaccagcaccaggagaggcttaagctcgggaggcagcgccaccgacgacagtatcgccttgtgtgtgtgctggtaatttatacaccgatccgtaaacgcgcgccgaatcttgggattgcggaggtggcgccggatgccctctgggacgtcatacgccaggccgtgggtgttggtctcggccgagttgacaaacagggctgggtgcagcacgcagcgataggcgagcagggccagggcgaagtccggcgacagctggttgttaaaatactggtaaccgggaaaccgggtcacgggtacgcccaggctcggggcgacgtacacgctaaccaccaactccagcagcgtctggcccagggcgtacaggtcaaccgctaacccgacgtcgtgcttcaggcggtggttggtaaattcggcccgttcgttgttaaggtatttcaccaacagctccgggggctggttatacccgtgacccaccagggtgtgaaagttggctgtggttagggcggtgggcatgccaaacatccggggggacttgaggtccggctcctggaggcaaaactgcccccgggcgatcgtggagttggagttgagggtgacgaggctaaagtcggcgaggacggcccgccggagcgagacggcgtccgaccgcagcatgacgaggatgttggcgcacttgatatccaggtggctgatcccgcaggtggtgtttaaaaacacaacggcgcgggccagctccgtgaagcactggtggagggccgtcgagaccgaggggtttgttgtgcgcagggacgccagttggccgatatacttaccgaggtccatgtcgtacgcggggaacactatctgtcgttgttgcagcgagaacccgaggggcgcgatgaagccgcggatgttgtgggtgcggccggcgcgtagaacgcactccccgaccaacagggtcgcgatgagctcaacggcaaaccactccttttcctttatggtcttaacggcaagcttatgttcgcgaatcagttggacgtcaccgtatcccccagaccccccgaagcttcgggccccggggatctcgagggtcgtgtagtgtagggcggggttgatggcgaacacggggctgcatagcttgcggatgcgcgtgagggtgaggatgtgcgagggggacgaggggggtgcggttaacgccgcctgggatctgcgcaggggcgggcggttcagtttggccgccgtaccgggcgtctcgggggacgcgcggcgatgagacgagcggctcattcgccatcgggatagtcccgcgcgaagccgctcgcggaggccggatcggtggcgggacccgtgggaggagcgggagacggcggcgtcctggagagaggggccgctggggcgcccggaggccccgtgggggttggagtgtacgtaggatgcgagccaatccttgaaggaccgttggcgtgcaccttgggggctgaggttagctgccacatgaccagcaggtcgctgtctgcgggactcatccatccttcggccaggtcgccgtctccccacagagaagcgttggtcgctgcttcctcgagttgctcctcctggtccgcaagacgatcgtccacggcgtccaggcgctcaccaagcgccggatcgaggtaccgtcggtgtgcggttagaaagtcacgacgcgccgcttgctcctccacgcgaattttaacacaggtcgcgcgctgtcgcatcatctctaagcgcgcgcgggactttagccgcgcctccaattccaagtgggccgcctttgcagccataaaggcgccaacaaaccgaggatcttgggtgctgacgccctcccggtgcagctgcagggtctggtccttgtaaatctcggctcggaggtgcgtctcggccaggcgtcggcgcagggccgcgtgggcggcatctcggtccattccgccaccctgcgggcgacccggggggtgctctgatagtctcgcgtgcccaaggcccgtgatcggggtacttcgccgccgcgacccgccacccggtgtgcgcgatgtttggtcagcagctggcgtccgacgtccagcagtacctggagcgcctcgagaaacagaggcaacttaaggtgggcgcggacgaggcgtcggcgggcctcaccatgggcggcgatgccctacgagtgccctttttagatttcgcgaccgcgacccccaagcgccaccagaccgtggtccctggcgtcgggacgctccacgactgctgcgagcactcgccgctcttctcggccgtggcgcggcggctgctgtttaatagcctggtgccggcgcaactaaaggggcgtgatttcgggggcgaccacacggccaagctggaattcctggcccccgagttggtacgggcggtggcgcgactgcggtttaaggagtgcgcgccggcggacgtggtgcctcagcgtaacgcctactatagcgttctgaatacgtttcaggccctccaccgctccgaagcctttcgccagctggtgcactttgtgcgggactttgcccagctgctcaaaacctccttccgggcctccagcctcacggagaccacgggcccccccaaaaaacgggccaaggtggacgtggccacccacggccggacgtacggcacgctggagctgttccaaaaaatgatccttatgcacgccacctactttctggccgccgtgctcctcggggaccacgcggagcaggtcaacacgttcctgcgtctcgtgtttgagatccccctgtttagcgacgcggccgtgcgccacttccgccagcgcgccaccgtgtttctcgtcccccggcgccacggcaagacctggtttctggtgcccctcatcgcgctgtcgctggcctcctttcgggggatcaagatcggctacacggcgcacatccgcaaggcgaccgagccggtgtttgaggagatcgacgcctgcctgcggggctggttcggttcggcccgagtggaccacgttaaaggggaaaccatctccttctcgtttccggacgggtcgcgcagtaccatcgtgtttgcctccagccacaacacaaacgtaagtcctcttttctttcgcatggctctcccaaggggccccgggtcgacccgacccacacccacccacccacatacacacacaaccagacgcgggaggaaagtctgccccgtgggcactgatttttattcgggatcgcttgaggaggcccgggcaacggcccgggcaacggtggggcaactcgtagcaaataggcgactgatgtacgaagagaagacacacaggcgccacccggcgctggtcggggggatgttgtccgcgccgcaccgtcccccgacgacctcttgcagacggtccgtgatgcaaggacggcggggggcctgcagcagggtgaccgtatccacgggatggccaaagagaagcggacacaggctagcatccccctggaccgccagggtacactgggccatcttggcccacagacacggggcgacgcagggacaggactccgttacgacggaggagagccacagtgcgttggcggaatcgatgtggggcggcggggcgcaggactcgcagccccccgggtggttggtgatcctggccaggagccatcccagatggcgggccctgcttcccggtggacagagcgaccccaggtcgctgtccatggcccagcagtagatctggccgctggggaggtgccaccaggcccccgggcccaaggcgcagcacgcgcccggctccgggggggtcttcgcggggaccagatacgcgccatccagctcgccgaccactggctcctccgcgagctgttcggtggttgggtcgggggtttcctccgggggggtggccgcccgtatgcgtgcgaacgtgagggtgcacaggagcggggtcagggggtgcgtcacgctccggaggtggacgatcgcgcagtagcggcgctcgcggttaaagaaaaagagggcaaagaaggtgttcgggggcaaccgcagcgccttggggcgcgtcagatacagaaaaatctcgcagaagagggcgcgcccggggtctgggttaggaagggccacctgacacagaggctcggtgaggaccgttagacaccgaaagatcttgagccgctcgtccgcccgaacgacgcgccacacaaagacggagttgacaatgcgcgcgatagagtcgacgtccgtccccaggtcgtcgactctatcgcgcgtgccgcgagctccggcccgggaatccggccggggcaaggtccccgggggaccaggcggcgccaggggccgccggggtcccagctgcgccatgccgggggcggggggagggcaaaccccagaggcgggggccaacggcgcggggaggagtgggtgggcgaggtggccgggggaaggcgcccgctagcgagaccggccgttcccggacgacaccttgcgacaaaacctaaggacagcggcccgcgcgacggggtccgagaggctaaggtaggccgcgatgttaatggtgaacgcaaagccgccgggaaagacaactatgccacagaggcggcgattaaaccccaggcagaggtaggcgtagctttccccgggcaggtattgctcgcagaccctgcgtggggctgtggaggggacggcctccatgaagcgacatttactctgctcgcgtttactgacgtcaccatccatcgccacggcgattggacgattgttaagccgcagcgtgtctccgcttgtgctgtagtagtcaaaaacgtaatggccgtcggagtcggcaaagcgggccgggaggtcgtcgccgagcgggacgacccgccgcccccgaccgccccgtccccccaggtgtgccaggacggccagggcatacgcggtgtgaaaaaaggcgtcgggggcggtcccctcgacggcgcgcatcaggttctcgaggagaatggggaagcgcctggtcacctcccccaaccacgcgcgttggtcggggccaaagtcatagcgcaggcgctgtgagattcgcgggccgccctgaagcgcggcccggatggcctggcccagggcccggaggcacgccagatgtatgcgcgcggtaaaggcgacctcggcggcgatgtcaaagggcggcaggacggggcgcgggtggcgcaggggcacctcgagcgcgggaaagcgtagcagcagctccgcctgcccagcgggagacagctggtgggggcgcacgacgcgttctgcggcgcaggcctcggtcagggccgtggccagcgccgaggacagcagcggagggcgggcgcgtcgcccgccccacgccacggagttctcgtaggagacgacgacgaagcgctgcttggttccgtagtggtggcgcaggaccacggagatagaacgacggctccacagccagtccggccggtcgccgccggccagggcttcccatccgcgatccaaccactcgaccagcgaccgcggctttgcggtaccaggggtaagggttagaacgtcgttcaggatgtcctcgcccccgggcccgtggggcgctggggccacaaagcggcccccgccggggggctccagacccgccagcaccgcatctgcgtcagccgcccccatggcgcccccgctgacggcctggtgaaccagggcgccctggcgtagccccgatgcaacgccacaggccgcacgcccggtccgcgctcggaccgggtggcggcgggtgacgtcctgcactgcccgctgaaccaacgcgaggatctcctcgttctcctgtgcgatggacacgtcctgggccgcggtcgtgtcgccgccgggggccgtcagctgctcctccggggagatgggggggtcggacgccccgacgatgggcgggtctgcgggcgcccccgcgtggggccgggccaagggctgcggacgcggggacgcgctttcccccagacccatggacaggtgggccgcagcctccttcgcggccggcggggcggcggcgccaagcagagcgacgtagcggcacaaatgccgacagacgcgcatgatgcgcgtgctgtcggccgcgtagcgcgtgttgggggggacgagctcgtcgtaactaaacagaatcacgcgggcacagctcgcccccgagccccacgcaaggcgcagcgccgccacggcgtacgggtcatagacgccctgcgcgtcacacaccacgggcagggagacgaacaaccccccggcgctggacgcacgcggaaggaggccagggtgtgccggcacgacgggggccagaagctcccccaccgcatccgcgggcacgtaggcggcaaacgccgtgcaccacggggtacagtcgccggtggcatgagcccgagtctggatttcgacctggaagtttgcggccgtcccgagtccggggcggccgcgcatcagggcggccagagggattcccgcggccgccaggcactcgctggatatgatgacgtgaaccaaagaccgagggccgacccgggccgtggccgagatcgtctggacctcgttggccaagtgcgcgttcatggttcgggggtgggtgtgggtgtgtaggcgatgcgggtcccccgagtccgcgggaagggcgtgggtttggcgcgcgtatgcgtattcgccaacggaggcgtgcgtgcttatgcgcggcgcgtttcttctgtctctagggaatccgaggccaggactttaacctgctctttgtcgacgaggccaactttattcgcccggatgcggtccagacgattatgggctttctcaaccaggccaactgcaagattatcttcgtgtcgtccaccaacaccgggaaggccagtacgagctttttgtacaacctccgcggggccgcagacgagcttctcaacgtggtgacctatatatgcgatgatcacatgccgagggtggtgacgcacacaaacgccacggcctgttcttgttatatcctcaacaagcccgttttcatcacgatggacggggcggttcgccggaccgccgatttgtttctggccgattccttcatgcaggagatcatcgggggccaggccagggagaccggcgacgaccggcccgttctgaccaagtctgcgggggagcggtttctgttgtaccgcccctcgaccaccaccaacagcggcctcatggcccccgatttgtacgtgtacgtggatcccgcgttcacggccaacacccgagcctccgggaccggcgtcgctgtcgtcgggcggtaccgcgacgattatatcatcttcgccctggagcacttttttctccgcgcgctcacgggctcggcccccgccgacatcgcccgctgcgtcgtccacagtctgacgcaggtcctggccctgcatcccggggcgtttcgcggcgtccgggtggcggtcgagggaaatagcagccaggactcggccgtcgccatcgccacgcacgtgcacacagagatgcaccgcctactggcctcggagggggccgacgcgggctcgggccccgagcttctcttctaccactgcgagcctcccgggagcgcggtgctgtacccctttttcctgctcaacaaacagaagacgcccgcctttgaacactttattaaaaagtttaactccgggggcgtcatggcctcccaggagatcgtttccgcgacggtgcgcctgcagaccgacccggtcgagtatctgctcgagcagctaaataacctcaccgaaaccgtctcccccaacactgacgtccgtacgtattccggaaaacggaacggcgcctcggatgaccttatggtcgccgtcattatggccatctacctcgcggcccaggccggacctccgcacacattcgctcctatcacacgcgtctcgtgagcgcccaataaacacacccaggtatgctacgcacgaccacggtgtcgtctgttaaggggggggggggaagggggtgttggcgggaagcgtgggaacacgggggattctctcacgaccggcaccagtaccacccccctgtgaacacagaaaccccaacccaaatcccataaacatacgacacacaggcatattttggaatttcttaggtttttatttatttaggtatgctggggtttctccctggatgcccacccccacccccccgtgggtctagccgggccttagggatagcgtataacgggggccatgtctccggaccgcacaacggccgcgccgtcaaaggtgcacacccgaaccacgggagccagggccaaggtgtctcctagttggcccgcgtgggtcagccaggcgacgagcgcctcgtaaagcggcagccttcgctctccatcctgcatcagggccggggcttcggggtgaatgagctgggcggcctcccgcgtgacactctgcatctgcagtagagcgttcacgtacccgtcctgggcacttagcgcaaagagccgggggattagcgtaaggatgatggtggttccctccgtgatcgagtaaaccatgttaaggaccagcgatcgcagctcggcgtttacgggaccgagttgttggacgtccgccagcagcgagaggcgactcccgttgtagtacagcacgttgaggtctggcagccctccggggtttctggggctggggttcaggtcccggatgcccctggccacgagccgcgccacgatttcgcgcgccaggggcgatggaagcggaacgggaaaccgcaacgtgaggtccagcgaatccaggcgcacgtccgtcgcttggccctcgaacacgggcgggacgaggctgatggggtccccgttacagagatctacgggggaggtgttgcgaaggttaacggtgccggcgtgggtgaggcccacgtccagggggcaggcgacgattcgcgtgggaagcacccgggtgatgaccgcggggaagcgccttcggtacgccagcaacaaccccaacgtgtcgggactgacgcctccggagacgaaggattcgtgcgccacgtcggccagcgtcagttgccggcggatggtcggcaggaataccacccgcccttcgcagcgctgcagcgccgccgcatcggggcgcgagatgcccgagggtatcgcgatgtcagtttcaaagccgtccgccagcatggcgccgatccacgcggcagggagtgcagtggtggttcgggtggcgggaggagcgcggtgggggtcagcggcgtagcagagacgggcgaccaacctcgcataggacggggggtgggtcttagggggttgggaggcgacagggaccccagagcatgcgcggggaggtctgtcgggcccagacgcaccgagagcgaatccgtccgcggagtcccggcttgggttttatggggcccggccctcggaatcgcggcttgtcggcggggacaaagggggcggggctaggggcttgcggaaacagaagacgcgtgggataaaagaatcgcactaccccaaggaagggcggggcggtttattacagagccagtcccttgagcggggatgcgtcatagacgagatactgcgcgaagtgggtctcccgcgcgtgggcttccccgttgcgggcactgcggaggagggcggggtcgctggcgcaggtgagcgggtaggcctcctgaaacaggccacacgggtcctccacgagttcgcggcaccccggggggcgcttaaactgtacgtcgctggcggcggtggccgtggacaccgccgaacccgtctccacgatcaggcgctccaggcagcgatgtttggcggcgatgtcggccgacgtaaagaacttaaagcaggggctgagcaccggcgaggccccgttgaggtggtaggccccgttatagagcaggtccccgtacgaaaatcgctgcgacgcccacgggttggccgtggccgcgaaggcccgggacgggtcgctctggccgtggtcgtacatgagggcggtgacatccccctccttgtcccccgcgtaaacgcccccggcggcgcgtccccgggggttgcagggccggcggaagtagttgacgtcggtcgacacgggggtggcgataaactcacacacggcgtcctggccgtggtccatccctgcgcgccgcggcacctgggcgcacccgaacacggggacgggctgggccggccccaggcggtttcccgccacgaccgcgttccgcaggtacacggctgccgcgttgtccaggagagggggagccccgcggcccaggtaaaagttttggggaaggttgcccatgtcggtgacggggttgcggacggttgccgtggccacgacggcggtgtagcccacgcccaggtccacgttcgcgcgcggctgggtgagcgtgaagtttacccccccgccagtttcgtgccgggccacctggagctggcccaggaagtacgcctccgacgcgcgctccgagaacagcacgttctcagtcacaaagcggtcctgtcggacgacggtgaacccaaacccgggatggaggcccgtcttgagctgatgatgcaaggccacgggactgatcttgaagtaccccgccatgagcgcgtaggtcagcgcgttctccccggccgcgctctcgcggacgtgctgcacgacgggctgtcggatcgacgaaaagtagttggcccccagagccggggggaccagggggacctgccgcgacaggtcgcgcagggccggggggaaattgggcgcgttcgccacgtggtcggccccggcgaacagcgcgtggacggggagggggtaaaaatagtcgccattttggatggtatggtccagatgctggggggccatcagcaggattccggcgtgcaacgccccgtcgaatatgcgcatgttggtggtggacgcggtgttggcgcccgcgtcgggcgccgccgagcagagcagcgccgttgtgcgttcggccatgttgtgggccagcacctgcagcgtgagcatggcgggcccgtccactaccacgcgcccgttgtgaaacatggcgttgaccgtgttggccaccagattggccgggtgcagggggtgcgcggggtccgtcacggggtcgctggggcactcctcgccgggggcgatctccgggaccaccatgttctgcagggtggcgtatacgcggtcgaagcgaacccccgcggtgcagcagcggccccgcgagaaggcgggcaccatcacgtagtagtaaatcttgtggtgcacggtccagtccgccccccggtgcggccggtcatccgcggcgtccgcggctcgggcctgggtgttgtgcagcagctggccgtcgttgcggttgaagtccgcggtcgccacgttacatgccgccgcgtacacggggtcgtggccccccgcgctaacccggcagtcgcgatggcggtccagggccgcgcgccgcatcagggcgtcacagtcccacacgaggggtggcagcagcgccgggtctcgcattaggtgattcagctcggcttgcgcctgcccgcccagctccgggccggtcagggtaaagtcatcaaccagctgggccagggcctcgacgtgcgccaccaggtcccggtacacggccatgcactcctcgggaaggtctcccccgaggtaggtcacgacgtacgagaccagcgagtagtcgttcacgaacgccgcgcaccgcgtgttgttccagtagctggtgatgcactggaccacgagccgggccagggcgcagaagacgtgctcgctgccgtgtatggcggcctgcagcaggtaaaacaccgccgggtagttgcggtcgtcgaacgccccgcgaacggcggcgatggtggcgggggccatggcgtggcgtcccacccccagctccaggccccgggcgtcccggaacgccgccggacatagcgccaggggcaagttgccgttcaccacgcgccaggtggcctggatctcccccgggccggccgggggaacgtccccccccggcagctccacgtcggccacccccacaaagaagtcgaacgcggggtgcagctcaagagccaggttggcgttgtcgggctgcataaactgctccggggtcatctggccttccgcgacccatcggacccgcccgtgggccaggcgctgcccccaggcgttcaaaaacagctgctgcatgtctgcggcggggccggccggggccgccacgtacgccccgtacggattggcggcttcgacggggtcgcggttaaggcccccgaccgccgcgtcaacgttcatcagcgaagggtggcacacggtcccgatcgcgtgttccagagacaggcgcagcacctggcggtccttcccccaaaaaaacagctggcggggcgggaaggcgcggggatccgggtggccgggggcggggactaggtccccggcgtgcgcggcaaaccgttccatgaccggattgaacaggcccaggggcaggacgaacgtcaggtccatggcgcccaccagggggtagggaacgttggtggcggcgtagatgcgcttctccagggcctccagaaagaccagcttctcgccgatggacaccagatccgcgcgcacgcgcgtcgtctggggggcgctctcgagctcgtccagcgtctgccggttcaggtcgagctgctcctcctgcatctccagcaggtggcggcccacgtcgtccagacttcgcacggccttgcccatcacgagcgccgtgaccaggttggccccgttcaggaccatctcgccgtacgtcaccggcacgtcggcttcggtgtcctccactttcaggaaggactgcaggaggcgctgtttgatcggggcggtggtgacgagcaccccgtcgaccggccgcccgcgcgtgtcggcatgcgtcagacggggcacggccacggagggctgcgtggccgtggtgaggtccacgagccaggcctcgacggcctcccggcggtggcccgccttgcccaggaaaaagctcgtctcgcagaagcttcgctttagctcggcgaccagggtcgcccgggccaccctggtggccaggcggccgttgtccaggtatcgttgcatcggcaacaacaaagccaggggcggcgccttttccagcagcacgtgcagcatctggtcggccgtgccgcgctcaaacgccccgaggacggcctggacgttgcgagcgagctgttggatggcgcgcaactggcgatgcgcgccgatacccgtcccgtccagggcctcccccgtgagcagggcgatggcctcggtggccaggctgaaggcggcgttcagggcccggcggtcgataatcttggtcatgtaattgtgtgtgggttgctcgatggggtgcgggccgtcgcgggcaatcagcggctggtggacctcgaactgtacgcgcccctcgttcatgtaggccagctccggaaacttggtacacacgcacgccaccgacaacccgagctccagaaagcgcacgagcgacagggtgttgcaatacgaccccagcagggcgtcgaactcgacgtcgtacaggctgtttgcatcggagcgcacgcgggaaaaaaaatcaaacaggcgtcgatgcgacgccacctcgatcgtgctaaggagggacccggtcggcaccatggccgcggcataccggtatcccggagggtcgcggttgggagcggccatggggtcgcgtggagatcggctgtctctagcgatattggcccggggaggctaagatccaccccaacgcccggccacccgtgtacgtgcccgacggcccaaggtccaccgaaagacacgacgggcccggacccaaaaaggcgggggatgctgtgtgagaggccgggtgccggtcgggggggaaaggcaccgggagaaggctgcggcctcgttccaggagaacccagtgtccccaacagacccggggacgtgggatcccaggccttatatacccccccccccgccccacccccgttagaacgcgacgggtgcattcaagatggccctggtccaaaagcgtgccaggaagaaattggcagaggcggcaaagctgtccgccgccgccacccacatcgaggccccggccgcgcaggctatccccagggcccgtgtgcgcaggggatcggtgggcggcagcatttggttggtggcgataaagtggaaaagcccgtccggactgaaggtctcgtgggcggcggcgaacaaggcacacagggccgtgcctcccaaaaacacggacatcccccaaaacacgggcgccgacaacggcagacgatccctcttgatgttaacgtacaggaggagcgcccgcaccgcccacgtaacgtagtagccgacgatggcggccaggatacaggccggcgccaccacccttccggtcagcccgtaatacatgcccgctgccaccatctccaacggcttcaggaccaaaaacgaccaaaggaacagaatcacgcgctttgaaaagaccggctgggtatggggcggaagacgcgagtatgccgaactgacaaaaaaatcagaggtgccgtacgaggacaatgaaaactgttcctccagcggcagttctccctcctcccccccgaaggcggcctcgtcgaccagatctcgatccaccagaggaaggtcatcccgcatggtcatggggtgtgcggtggaggtggggagaccgaaaccgcaaagggtcgcttacgtcagcaggatcccgagatcaaagacacccgggttcttgcacaaacaccacccgggttgcatccgcggaggcgagtgttttgataaggccgttccgcgccttgatataacctttgatgttgaccacaaaacccggaatttacgcctacgccccaatgcccacgcaagatgaggtaggtaacccccccgtgggtgtgacgttgcgtttagttcattggaggccaaggggaaaaatggggtggggaggaaacggaaaacccagtaggccgtgtcgggaacacgcccggggttgtcctcaaaaggcagggtccatactacggaagccgtcgttgtattcgagacctgcctgtgcaacgcacgtcggggttgcctgtgtccggttcggcccccaccgcgtgcggcacgcacgaggacgagtccgcgtgctttattggcgttccaagcgttgccctccagtttctgttgtcggtgttcccccatacccacgcccacatccaccgtagggggcctctgggccgtgttacgtcgccgcccgcgatggagcttagctacgccaccaccatgcactaccgggacgttgtgttttacgtcacaacggaccgaaaccgggcctactttgtgtgcggggggtgtgtttattccgtggggcggccgtgtgcctcgcagcccggggagattgccaagtttggtctggtcgttcgagggacaggcccagacgaccgcgtggtcgccaactatgtacgaagcgagctccg

SEQ ID NO: 844 - DNA, 32767 bp, synthetic construct; identical to SEQ ID NO: 843
  misc_feature 1..32767: note = recombinant viral vector ONCR-136
  source 1..32767: mol_type = other DNA

SEQ ID NO: 845 - DNA, 32767 bp, synthetic construct; identical to SEQ ID NO: 843
  misc_feature 1..32767: note = recombinant viral vector ONCR-142
  source 1..32767: mol_type = other DNA

SEQ ID NO: 846 - DNA, 32767 bp, synthetic construct; identical to SEQ ID NO: 843
  misc_feature 1..32767: note = recombinant viral vector ONCR-154
  source 1..32767: mol_type = other DNA

SEQ ID NO: 847 - DNA, 32767 bp, synthetic construct; identical to SEQ ID NO: 843
  misc_feature 1..32767: note = recombinant viral vector ONCR-155
  source 1..32767: mol_type = other DNA

SEQ ID NO: 848 - DNA, 32767 bp, synthetic construct; identical to SEQ ID NO: 843
  misc_feature 1..32767: note = recombinant viral vector ONCR-156
  source 1..32767: mol_type = other DNA

SEQ ID NO: 849 - DNA, 32767 bp, synthetic construct
  misc_feature 1..32767: note = recombinant viral vector ONCR-157
  source 1..32767: mol_type = other DNA
aaaaaagctgaacgagaaacgtaaaatgatataaatatcaatatattaaattagattttgcataaaaaacagactacataatactgtaaaacacaacatatccagtcactatgaatcaactacttagatggtattagtgacctgtagtcgaccgacagccttccaaatgttcttcgggtgatgctgccaacttagtcgaccgacagccttccaaatgttcttctcaaacggaatcgtcgtatccagcctactcgctattgtcctcaatgccgtattaaatcataaaaagaaataagaaaaagaggtgcgagcctcttttttgtgtgacaaaataaaaacatctacctattcatatacgctagtgtcatagtcctgaaaatcatctgcatcaagaacaatttcacaactcttatacttttctcttacaagtcgttcggcttcatctggattttcagcctctatacttactaaacgtgataaagtttctgtaatttctactgtatcgacctgcagactggctgtgtataagggagcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgcccgggcgtgtcaataatatcactctgtacatccacaaacagacgataacggctctctcttttataggtgtaaaccttaaactgcatttcaccagcccctgttctcgtcagcaaaagagccgttcatttcaataaaccgggcgacctcagccatcccttcctgattttccgctttccagcgttcggcacgcagacgacgggcttcattctgcatggttgtgcttaccagaccggagatattgacatcatatatgccttgagcaactgatagctgtcgctgtcaactgtcactgtaatacgctgcttcatagcatacctctttttgacatacttcgggtatacatatcagtatatattcttataccgcaaaaatcagcgcgcaaatacgcatactgttatctggcttttagtaagccggatccacgcggcgtttacgccccccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttagtcgactacaggtcactaataccatctaagtagttgattcatagtgactggatatgttgtgttttacagtattatgtagtctgttttttatgcaaaatctaatttaatatattgatatttatatcattttacgtttctcgttcagctttcttgtacaaagtggttttaatggaccgcccgcaagggggggggggcatttcagtgtcgggtgacgagcgcgatccggccgggatcctaggaccccaaaagtttgtctgcgtattccagggcggggctcagttgaatctcccgcagcacctctaccagcaggtccgcggtgggctggagaaactcggccgtcccggggcaggcggttgtcgggggtggaggcgcggcgcccaccccgtgtgccgcgcctggcgtctcctctgggggcgacccgtaaatggttgcagtgatgtaaatggtgtccgcggtccagaccacggtcaaaatgccggccgtggcgctccgggcgctttcgccgcgcgaggagctgacccaggagtcgaacggatacgcgtacatatgggcgtcccacccgcgttcgagcttctggttgctgtcccggcctataaagcggtaggcacaaaattcggcgcgacagtcgataatcaccaacagcccaatgggggtgtgctggataacaacgcctccgcgcggcaggcggtcctggcgctcccggccccgtaccatgatcgcgcgggtgccgtactcaaaaacatgcaccacctgcgcggcgtcgggcagtgcgctggtcagcgaggccctggcgtggcataggctatacgcgatggtcgtctgtggattggacatctcgcggtgggtagtgagtcccccgggccgggttcggtggaactgtaaggggacggcgggttaatagacaatgaccacgttcggatcgcgcagagccgatagtatgtgctcactaatgacgtcatcgcgctcgtggcgctcccggagcggatttaagttcatgcgaaggaattcggaggaggtggtgcgggacatggccacgtacgcgctgttgaggcgcaggttgccgggcgtaaagcagatggcgaccttgtccaggctaaggccctgggagcgcgtgatggtcatggcaagcttggagctgatgccgtagtcggcgtttatggccatggccagctccgtagagtcaatggactcgacaaactcgctgatgttggtgttgacgacggacatgaagccgtgttggtcccgcaagaccacgtaaggcaggggggcctcttccagtaactcggccacgttggccgtcgcgtgccgcctccgcagctcgtccgcaaaggcaaacacccgtgcgtacgtgtatcccatgagcgtataattgtccgtctgcagggcgacggacatcagccccccgcgcggcgagccggtcagcatctcgcagccccggaagataacgttgtccacgtacgtgctaaagggggcgacttcaaatgcctccccgaagagctcttggaggattcggaatctcccgaggaaggcccgcttcagcagcgcaaactgggtgtgaacggcggcggtggtctccggttccccgggggtgtagtggcagtaaaacacgtcgagctgttgttcgtccagccccgcgaaaataacgtcgaggtcgtcgtcgggaaaatcgtccgggcccccgtcccgcggccccagttgcttaaaatcaaacgcacgctcgccgggggcgcctgcgtcggccattaccgacgcctgcgtcggcacccccgaagatttggggcgcagagacagaatctccgccgttagttctcccatgcgggcgtaggcgagggtcctctgggtcgcatccaggcccgggcgctgcagaaagttgtaaaaggagataagcccgctaaatatgagccgcgacaggaacctgtaggcaaactccaccgaagtctccccctgagtctttacaaagctgtcgtcacgcaacactgcctcgaaggcccggaacgtcccactaaacccaaaaaccagttttcgcaggcgcgcggtcaccgcgatctggctgttgaggacgtaagtgacgtcgttgcgggccacgaccagctgctgtttgctgtgcacctcgcagcgcatgtgccccgcgtcctggtcctggctctgcgagtagttggtgatgcggctggcgttggccgtgagccacttttcaatcgtcaggccgggctggtgtgtcagccgtcggtattcgtcaaactccttgaccgacacgaacgtaagcacggggagggtgaacacgacgaactccccctcacgggtcaccttcaggtaggcgtggagcttggccatgtacgcgctcacctctttgtgggaggagaacagccgcgtccagccggggaggttggcggggttggtgatgtagttttccgggacgacgaagcgatccacgaactgcatgtgctcctcggtgatgggcaggccgtactccagcaccttcatgaggttaccgaactcgtgctcgacgcaccgtttgttgttaataaaaatggcccagctatacgagaggcgggcgtactcgcgcagcgtgcggttgcagatgaggtacgtgagcacgttctcgctctggcggacggaacaccgcagtttctggtgctcgaaggtcgactccagggacgccgtctgcgtcggcgagcccacacacaccaacacgggccgcaggcgggccgcgtactggggggtgtggtacagggcgttaatcatccaccagcaatacaccacggccgtgaggaggtgacgcccaaggagcccggcctcgtcgatgacgatcacgttgctgcgggtaaaggccggcagcgccccgtgggtggccggggccaaccgcgtcagggcgccctcggccaaccccagggtccgttccagggcggccagggcgcgaaactcgttccgcaactcctcgcccccggaggcggccagggcgcgcttcgtgaggtccaaaatcacctcccagtagtacgtcagatctcgtcgctgcaggtcctccagcgaggcggggttgctggtcagggtgtacgggtactgtcccagttgggcctggacgtgattcccgcgaaacccaaattcatgaaagatggtgttgatgggtcggctgagaaaggcgcccgagagtttggcgtacatgttttgggccgcaatgcgcgtggcgcccgtcaccacacagtccaagacctcgttgattgtctgcacgcacgtgctctttccggagccagcgttgccggtgataagatacaccgcgaacggaaactccctgaggggcaggcctgcgggggactctaaggccgccacgtcccggaaccactgcagatggggcacttgcgctccgtcgagctgttgttgcgagagctctcggatgcgcttaaggattggctgcaccccgtgcatagacgtaaaatttaaaaaggcctcggccctccctggaacggctggtcggtccccgggttgctgaaggtgcggcgggccgggtttctgtccgtctagctggcgctccccgccggccgccgccatgaccgcaccacgctcgcgggcccccactacgcgtgcgcggggggacacggaagcgctgtgctcccccgaggacggctgggtaaaggttcaccccagccccggtacgatgctgttccgcgagattctccacgggcagctggggtataccgagggccagggggtgtacaacgtcgtccggtccagcgaggcgaccacccggcagctgcaggcggcgatctttcacgcgctcctcaacgccaccacttaccgggacctcgaggcggactggctcggccacgtggcggcccgcggtctgcagccccaacggctggttcgccggtacaggaacgcccgggaggcggatatcgccggggtggccgagcgggtgttcgacacgtggcggaacacgcttaggacgacgctgctggactttgcccacgggttggtcgcctgctttgcgccgggcggcccgagcggcccgtcaagcttccccaaatatatcgactggctgacgtgcctggggctggtccccatattacgcaagcgacaagaagggggtgtgacgcagggtctgagggcgtttctcaagcagcacccgctgacccgccagctggccacggtcgcggaggccgcggagcgcgccggccccgggttttttgagctggcgctggccttcgactccacgcgcgtggcggactacgaccgcgtgtatatctactacaaccaccgccggggcgactggctcgtgcgagaccccatcagcgggcagcgcggagaatgtctggtgctgtggccccccttgtggaccggggaccgtctggtcttcgattcgcccgtccagcggctgtttcccgagatcgtcgcgtgtcactccctccgggaacacgcgcacgtctgccggctgcgcaataccgcgtccgtcaaggtgctgctggggcgcaagagcgacagcgagcgcggggtggccggtgccgcgcgggtcgttaacaaggtgttgggggaggacgacgagaccaaggccgggtcggccgcctcgcgcctcgtgcggcttatcatcaacatgaagggcatgcgccacgtaggcgacattaacgacaccgtgcgttcctacctcgacgaggccggggggcacctgatagacgccccggccgtcgacggtaccctccctggattcggcaagggcggaaacagccgcgggtctgcgggccaggaccagggggggcgggcgccgcagcttcgccaggccttccgcacggccgtggttaacaacatcaacggcgtgttggagggctatataaataacctgtttggaaccatcgagcgcctgcgcgagaccaacgcgggcctggcgacccaattgcaggagcgcgaccgcgagctccggcgcgcaacagcgggggccctggagcgccagcagcgcgcggccgacctggcggccgagtccgtgaccggtggatgcggcagccgccctgcgggggcggacctgctccgggccgactatgacattatcgacgtcagcaagtccatggacgacgacacgtacgtcgccaacagctttcagcacccgtacatcccttcgtacgcccaggacctggagcgcctgtcgcgcctctgggagcacgagctggtgcgctgttttaaaattctgtgtcaccgcaacaaccagggccaagagacgtcgatctcgtactccagcggggcgatcgccgcattcgtcgccccctactttgagtcagtgcttcgggccccccgggtaggcgcgcccatcacgggctccgatgtcatcctgggggaggaggagttatgggatgcggtgtttaagaaaacccgcctgcaaacgtacctgacagacatcgcggccctgttcgtcgcggacgtccagcacgcagcgctgcccccgcccccctccccggtcggcgccgatttccggcccggcgcgtccccgcggggccggtccagatcgcggtcgcccggaagaactgcgcgaggcgcgccggaccagggcgggggcatcgggcaccgggatggccgccgcgacggccgacgatgaggggtcggccgccaccatcctcaagcaggccatcgccggggaccgcagcctggtcgaggcggccgaggcgattagccagcagacgctgctccgcctggcctgcgaggtgcgccaggtcggcgaccgccagccgcggtttaccgccaccagcatcgcgcgcgtcgacgtcgcgcctgggtgccggttgcggttcgttctggacgggagtcccgaggacgcctatgtgacgtcggaggattactttaagcgctgctgcggccagtccagttatcgcggcttcgcggtggcggtcctgacggccaacgaggaccacgtgcacagcctggccgtgccccccctcgttctgctgcaccggttctccctgttcaaccccagggacctcctggactttgagcttgcctgtctgctgatgtacctggagaactgcccccgaagccacgccaccccgtcgacctttgccaaggttctggcgtggctcggggtcgcgggtcgccgcacgtccccattcgaacgcgttcgctgccttttcctccgcagttgccactgggtcctaaacacactcatgttcatggtgtacgtaaaaccgttcgacgacgagttcgtcctgccccactggtacatggcccggtacctgctggccaacaacccgccccccgttctctcggccctgttctgtgccaccccgacgagctcctcattccggctgccggggccgcccccccgctccgactgcgtggcctataaccccgccgggatcatggggagctgctgggcgtcggaggaggtgcgcgcgcctctggtctattggtggctttcggagaccccaaaacgacagacgtcgtcgctgttttatcagttttgttgaattttaggaaataaacccggttttgtttctgtggcctcccgacggatgcgcgtgtccttcctccgtcttggtgggtgggtgtctgtgtatcgcgtcccatctgtgcggagagggggggcatgtcggcacgtattcggacagactcaagcacacacgggggagcgctcttgtctcagggcaatgtttttattggtcaaacttggttattgcttaagaatacgcgtagttgatcgtaccgtgagtaataatgtgactgtactgcatcaggaactgattggaattctcgtaccgtgagtaataatgtgggggtactgcatcaggaactgattggaatagttattgcttaagaatacgcgtagtaattactgcatcaggaactgattggatttatcgtaccgtgagtaataatgtggcggttattgcttaagaatacgcgtaggctttcgtaccgtgagtaataatgtggtcgtactgcatcaggaactgattggaagtcttattgcttaagaatacgcgtagcatatcaggcaaacagaaacgacatcttgtcgtcaaagggatacacaaacttccccccctctccccatactcccgccagcaccccggtaaacaccaactcaatctcgcgcaggatttcgcgcaggtgatgagcgcagtccacgggggggagcacaaggggccgcgggtatagatcgacggggacgccgaccgactccccgcctccgggacagacacgcacgacgcgccgccagtagtgctctgcgtccagcaaggcgccgccgcggaaggcagtggggggcaaggggtcgctggcctcaaagggggacacccgaacgctccagtactccgcgtccaaccgtttattaaacgcgtccaagataaggcggtcgcaggcgtcctccataaggccccgggccgtgagtgcgtcctcctccggcacgcatgccgttgtcaggcccaggacccgtcgcagcgtgtcgcgtacgacccctgccgccgtggtgtacgcgggcccgcggagaggaaatcccccaagatggtcagtgttgtcgcgggagttccagaaccacactcccgcctggctccaggcgactgcgtgggtgtagacgccctcgagggccaggcacagtgggtgccgcagccggacggcgttggccctaagcacggctcccacggccgtctcgatggcccgccgggcgtcctcgatcaccccggaagccgcatccgcgtcttgggggtccacgttaaagacaccccagaacgcacccccatcgcccccgcagaccgcgaacttcaccgagctggccgtctcctcgatctgcaggcagacggcggccattaccccacccaggagctgccgcagcgcagggcaggcgttgcacgtgtccgggaccaggcgctccaagacggccccggcccagggctctgagggagcggccaccaccagcgcgtccagtcttgctaggcccgtccggccgtgggggtccgccagcccgctccccccgaggtcggccagggccgccaggagctgggcgcgaagtccggggaagcaaaaccgcgccgtccagacgggcccgacggccgcgggcgggtctaacagttggatgattttagtggcgggatgccaccgcgccaccgcctcccgcaccgcgggcaggaggcatccggctgccgccgaggccacgccgggccaggctcgcggggggaggacgaccctggcccccaccgcgggccaggcccccaggagcgcggcgtaagcggccgcggccccgcgcaccaggtcccgtgccgactcggccgtggccggcacggtgaacgtgggccaacccggaaaccccaggacggcaaagtacgggacgggtcccccccggacctcaaactcgggccccagaaaggcaaagacgggggccagggccccgggggcggcgtggaccgtggtatgccactgccggaaaagggcgacgagcgccggcgcggagaacttctcgccggcgcttacaaagtagtcgtaatcgcggggcagcagcacccgtgccgtgactcgttgcgggtgcccgcgtggccgcaggcccacctcgcacacctcgaccaggtccccgaacgcgccctccttcttgatcggcggaaacgcaagagtctggtattcgcgcgcaaatagcgcggttccggtggtgatgttaacggtcagcgaagcggcggacgcgcactggggggtgtcgcgaatggccgccaggcgcgcccacgccagccgcgcgtcgggatgctcggcaacgcgcgccgccagggccatagggtcgatgtcaatgttggcctccgcgaccaggagagcggcgcgaggggcggcgggcgggccccacgacgctctctcaactttcaccaccagtcccgtgcgtgggtccgagccgatacgcagcggggcgaacagggccaccggcccggtctggcgctccagggccgccaggacgcacgcgtacagcgcccgccacagagtcgggttctccaggggctccagcggggaggcggccggcgtcgtcgcggcgcgggcggccgccacgacggcctggacggagacgtccgcggagccgtagaaatcccgcagctccgtcgcggtgacggagacctccgcaaagcgcgcgcgaccctcccctgcggcgttgcgacatacaaaatacaccagggcgtggaagtactcgcgagcgcgggggggcagccataccgcgtaaagggtaatggcgctgacgctctcctccacccacacgatatctgcggtgtccatcgcacggcccctaaggatcacgggcggtctgtgggtcccatgctgccgtgcctggccgggcccggtgggtcgcggaaaccggtgacggggggggggcggtttttggggttggggtgggggtgggaaacggcccgggtccgggggccaacttggcccctcggtgcgttccggcaacagcgccgccggtccgcggacgaccacgtaccgaacgagtgcggtcccgagacttatagggtgctaaagttcaccgccccctgcatcatgggccaggcctcggtggggagctccgacagcgccgcctccaggatgatgtcagcgttggggttggcgctggatgagtgcgtgcgcaaacagcgcccccacgcgggcacgcgtagcttgaagcgcgcgcccgcaaactcccgcttgtgggccataagcagggcgtacagctgcctgtgggtccggcaggcgctgtggtcgatgtggtgggcgtccaacaaccccacgattgtctgtttggtgaggtttttaacgcgccccgccccgggaaacgtctgcgtgcttttggccatctgcacgccaaacagttcgccccagattatcttgaacagcgccaccgcgtggtccgtctcgctaacggacccgcgcgggggacagccgcttagggcgtcggcgacgcgcttgacggcttcctccgagagcagaagtccgtcggttacgttacagtggcccagttcgaacaccagctgcatgtagcggtcgtagtggggggtcagtaggtccagcacgtcatcggggccgaaggtcctcccagatcccccggccgccgagtcccaatgcaggcgcgcggccatggtgctgcacaggcacaacagctcccagacgggggttacgttcagggtggggggcagggccacgagctccagctctccggtgacgttgatcgtggggatgacgcccgtggcgtagtggtcatagatccgccgaaatatggcgctgctgcgggtggccatgggaacgcggagacaggcctccagcaacgccaggtaaataaaccgcgtgcgtcccatcaggctgttgaggttgcgcatgagcgcgacaatttccgccggcgcgacatcggaccggaggtatttttcgacgaaaagacccacctcctccgtctcggcggcctgggccggcagcgacgcctcgggatcccggcaccgcagctcccgtagatcgcgctgggccctgagggcgtcgaaatgtacgccccgcaaaaacagacagaagtcctttggggtcagggtatcgtcgtgtccccagaagcgcacgcgtatgcagtttagggtcagcagcatgtgaaggatgttaaggctgtccgagagacacgccagcgtgcatctctcaaagtagtgtttgtaacggaatttgttgtagatgcgcgacccccgccccagcgacgtgtcgcatgccgacgcgtcacagcgccccttgaaccggcgacacagcaggtttgtgacctgggagaactgcgcgggccactggccgcaggaactgaccacgtgattaaggagcatgggcgtaaagacgggctccgagcgcgccccggagccgtccatgtaaatcagtagctcccccttgcggagggtgcgcacccgtcccagggactggtacacggacaccatgtccggtccgtagttcatgggtttcacgtaggcgaacatgccatcaaagtgcaggggatcgaagctgaggcccacggttacgaccgtcgtgtatataaccacgcggtattggccccacgtggtcacgtccccgaggggggtgagcgagtgaagcaacagcacgcggtccgtaaactgacggcagaaccgggccacgatctccgcgaaggagaccgtcgacgaaaaaatgcagatgttatcgcccccgccaaggcgcgcttccagctccccaaagaacgtggccccccgggcctccggagaggcgtccggagacgggccgctcggcggcccgggcgggcgcagggcagcctgcaggagctcggtccccagacgcgggagaaacaggcaccggcgcgccgaaaacccgggcatggcgtactcgccgaccaccacatgcacgtttttttcgccccggagaccgcacaggaagtccaccaactgcgcgttggcggttgcgtccatggcgatgatccgaggacagatgcgcagcaggcgtagcattaacgcatccacgcggcccagttgctgcatcgttggcgaatagagctggcccagcgtcgacataacctcgtccagaacgaggacgtcgtagttgttcagaaggttggggcccacgcgatgaaggctttccacctggacgataagtcggtggaaggggcggtcgttcataatgtaattggtggatgagaagtaggtgacaaagtcgaccaggcctgactcagcgaaccgcgtcgctagggtctgggtaaaactccgacgacaggagacgacgagcacactcgtgtccggagagtggatcgcttcccgcagccagcggatcagcgcggtagtttttcccgaccccattggcgcgcggaccacagtcacgcacctggccgtcggggcgctcgcgttggggaaggtgacgggtccgtgctgctgccgctcgatcgttgttttcgggtgaacccggggcacccattcggccaaatcccccccgtacaacatccgcgctagcgatacgctcgacgtgtactgttcgcactcgtcgtccccaatgggacgcccggcccccagaggatctcccgactccgcgccccccacgaaaggcatgaccggggcgcggacggcgtggtgggtctggtgtgtgcaggtggcgacgtttgtggtctctgcggtctgcgtcacggggctcctcgtcctggcctctgtgttccgggcacggtttccctgcttttacgccacggcgagctcttatgccggggtgaactccacggccgaggtgcgcgggggtgtagccgtgcccctcaggttggacacgcagagccttgtgggcacttatgtaatcacggccgtgttgttgttggccgtggccgtgtatgccgtggtcggcgccgtgacctcccgctacgaccgcgccctggacgcgggccgccgtctggctgcggcccgcatggccatgccgcacgccacgctgatcgccggaaacgtctgctcttggttgctgcagatcaccgtcctgttgctggcccatcgcatcagccagctggcccacctggtttacgtcctgcactttgcgtgtctggtgtattttgcggcccatttttgcaccaggggggtcctgagcgggacgtatctgcgtcaggtgcacggcctgatggagctggccccgacccatcatcgcgtcgtcggcccggctcgcgccgtgctgacaaacgccttgctgttgggcgtcttcctgtgcacggccgacgccgcggtatccctgaataccatcgccgcgttcaactttaatttttcggccccgggcatgctcatctgcctgaccgtgctgttcgccattctcgtcgtatcgctgttgttggtggtcgagggggtgttgtgtcactacgtgcgcgtgttggtgggcccccacctgggggccgtggccgccacgggcatcgtcggcctggcctgcgagcactattacaccaacggctactacgttgtggagacgcagtggccgggggctcagacgggagtccgcgtcgccctcgccctggtcgccgcctttgccctcggcatggccgtgctccgctgcacccgcgcctatctgtatcacaggcggcaccacaccaaattttttatgcgcatgcgcgacacgcgacaccgcgcacattccgccctcaagcgcgtacgcagttccatgcgcggatcgcgagacggccgccacaggcccgcacccggcagcccgcccgggattcccgaatatgcggaagacccctacgcgatctcatacggcggccagctcgaccggtacggagattccgacggggagccgatttacgacgaggtggcggacgaccaaaccgacgtattgtacgccaagatacaacacccgcggcacctgcccgacgacgatcccatctatgacaccgttggggggtacgaccccgagcccgccgaggaccccgtgtacagcaccgtccgccgttggtagctgtttggttccgttttaataaaccgtttgtgtttaacccgaccgtggtgtatgtctggtgtgtggcgtccgatcccgttactatcaccgtccccccccccccctcaaccccggcgattgtgggttttttaaaaacgacacgcgtgcgaccgtatacagaacattgttttggtttttattcgctatcggacatggggggtggaaactgggtggcggggcaggcgcctccgggggtccgccggtgagtgtggcgcgagggggggtccgatgaacgcaggcgctgtctccccggggcccgcgtaaccccgcgcatatccgggggcacgtagaaattaccttcctcttcggactcgatatccacgacgtcaaagtcgtgggcggtcagcgagacgacctccccgtcgtcggtgatgaggacgttgtttcggcagcagcagggccgggccccggagaacgagaggcccatagctcggcgagcgtgtcgtcgaatgccaggcggctgcttcgctggatggccttatagatctccggatcgatgcggacgggggtaatgatcagggcgatcggaacggcctggttcgggagaatggacgccttgctgggtcctgcggccccgagagccccggcgccgtcctccaggcggaacgttacgccctcctccgcgctggtgcggtgcctgccgataaacgtcaccagatgcgggtggggggggcagtcggggaagtggctgtcgagcacgtagccctgcaccaagatctgcttaaagttcgggtgacgggggttcgcgaagacgggctcgcggcggaccagatccccggagctccaggacacgggggagatggtgtggcgtccgaggtcgggggcgccaaacagaagcacctccgagacaacgccgctatttaactccaccaaggcccgatccgcggcggagcaccgccttttttcgcccgaggcgtgggcctctgaccaggcctggtcttgcgtgacgagagcctcctccgggccggggacgcgcccgggcgcgaagtatcgcacgctgggcttcgggatcgaccggataaatgcccggaacgcctccggggaccggtgtgccatcaagtcctcgtacgcggaggccgtggggtcgctggggtccatggggtcgaaagcgtacttggcccggcatttgacctcgtaaaaggccaggggggtcttggggactggggccaggtagccgtgaatgtcccgaggacagacgagaatatccagggacgccccgaccatccccgtgtgaccgtccatgaggaccccacacgtatgcacgttctcttcggcgaggtcgctgggttcgtggaagataaagcgccgcgtgtcggcgccggcctcgccgccgtcgtccgcgcggcccacgcagtagcgaaacagcaggcttcgggccgtcggctcgttcacccgcccgaacatcaccgccgaagactgtacatccggccgcaggctggcgttgtgcttcagccactggggcgagaaacacggaccctgggggccccagcggagggtggatgcggtcgtgaggccccgccggagcagggcccatagctggcagtcggcctggttttgcgtggccgcctcgtaaaaccccatgaggggccggggcgccacggcgtccgcggcggccgggggcccgcggcgcgtcaggcgccataggtgccgaccgagtccgcggtccaccatacccgcctcctcgaggaccacggccagggaacacagataatccaggcgggcccagaggggaccgatggccagaggggcgcggacgccgcgcagcaacccgcgcaggtggcgctcgaacgtctcggctagtatatgggagggcagcgcgttggggatcaccgacgccgaccacatagagtcaaggtccggggagtcgggatcggcgtccgggtcgcgggcgtgggtgcccccaggagatagcggaatgtctggggtcggaggccctgaggcgtcagaaagtgccggcgacgcggcccggggcttttcgtctgcggtgtcggtggcgtgctgatcacgtggggggttaacgggcgaatgggagctcgggtccacagctgatgtcgtctggggtggggggggcaggggacggaaggtggttgtcagcggaagactgttagggcgggggcgcttgggggggctgtcggggccacgaggggtgtcctcggccagggcccagggacgcttagtcacggtgcgtcccggcggacatgctgggcctaccgtggactccatttccgagacgacgtggggggagcggtggttgagcgcgccgccgggtgaacgctgattctcacgacagcgcgtgccgcgcgcacgggttggtgtgacacaggcgggacaccagcaccaggagaggcttaagctcgggaggcagcgccaccgacgacagtatcgccttgtgtgtgtgctggtaatttatacaccgatccgtaaacgcgcgccgaatcttgggattgcggaggtggcgccggatgccctctgggacgtcatacgccaggccgtgggtgttggtctcggccgagttgacaaacagggctgggtgcagcacgcagcgataggcgagcagggccagggcgaagtccggcgacagctggttgttaaaatactggtaaccgggaaaccgggtcacgggtacgcccaggctcggggcgacgtacacgctaaccaccaactccagcagcgtctggcccagggcgtacaggtcaaccgctaacccgacgtcgtgcttcaggcggtggttggtaaattcggcccgttcgttgttaaggtatttcaccaacagctccgggggctggttatacccgtgacccaccagggtgtgaaagttggctgtggttagggcggtgggcatgccaaacatccggggggacttgaggtccggctcctggaggcaaaactgcccccgggcgatcgtggagttggagttgagggtgacgaggctaaagtcggcgaggacggcccgccggagcgagacggcgtccgaccgcagcatgacgaggatgttggcgcacttgatatccaggtggctgatcccgcaggtggtgtttaaaaacacaacggcgcgggccagctccgtgaagcactggtggagggccgtcgagaccgaggggtttgttgtgcgcagggacgccagttggccgatatacttaccgaggtccatgtcgtacgcggggaacactatctgtcgttgttgcagcgagaacccgaggggcgcgatgaagccgcggatgttgtgggtgcggccggcgcgtagaacgcactccccgaccaacagggtcgcgatgagctcaacggcaaaccactccttttcctttatggtcttaacggcaagcttatgttcgcgaatcagttggacgtcaccgtatcccccagaccccccgaagcttcgggccccggggatctcgagggtcgtgtagtgtagggcggggttgatggcgaacacggggctgcatagcttgcggatgcgcgtgagggtgaggatgtgcgagggggacgaggggggtgcggttaacgccgcctgggatctgcgcaggggcgggcggttcagtttggccgccgtaccgggcgtctcgggggacgcgcggcgatgagacgagcggctcattcgccatcgggatagtcccgcgcgaagccgctcgcggaggccggatcggtggcgggacccgtgggaggagcgggagacggcggcgtcctggagagaggggccgctggggcgcccggaggccccgtgggggttggagtgtacgtaggatgcgagccaatccttgaaggaccgttggcgtgcaccttgggggctgaggttagctgccacatgaccagcaggtcgctgtctgcgggactcatccatccttcggccaggtcgccgtctccccacagagaagcgttggtcgctgcttcctcgagttgctcctcctggtccgcaagacgatcgtccacggcgtccaggcgctcaccaagcgccggatcgaggtaccgtcggtgtgcggttagaaagtcacgacgcgccgcttgctcctccacgcgaattttaacacaggtcgcgcgctgtcgcatcatctctaagcgcgcgcgggactttagccgcgcctccaattccaagtgggccgcctttgcagccataaaggcgccaacaaaccgaggatcttgggtgctgacgccctcccggtgcagctgcagggtctggtccttgtaaatctcggctcggaggtgcgtctcggccaggcgtcggcgcagggccgcgtgggcggcatctcggtccattccgccaccctgcgggcgacccggggggtgctctgatagtctcgcgtgcccaaggcccgtgatcggggtacttcgccgccgcgacccgccacccggtgtgcgcgatgtttggtcagcagctggcgtccgacgtccagcagtacctggagcgcctcgagaaacagaggcaacttaaggtgggcgcggacgaggcgtcggcgggcctcaccatgggcggcgatgccctacgagtgccctttttagatttcgcgaccgcgacccccaagcgccaccagaccgtggtccctggcgtcgggacgctccacgactgctgcgagcactcgccgctcttctcggccgtggcgcggcggctgctgtttaatagcctggtgccggcgcaactaaaggggcgtgatttcgggggcgaccacacggccaagctggaattcctggcccccgagttggtacgggcggtggcgcgactgcggtttaaggagtgcgcgccggcggacgtggtgcctcagcgtaacgcctactatagcgttctgaatacgtttcaggccctccaccgctccgaagcctttcgccagctggtgcactttgtgcgggactttgcccagctgctcaaaacctccttccgggcctccagcctcacggagaccacgggcccccccaaaaaacgggccaaggtggacgtggccacccacggccggacgtacggcacgctggagctgttccaaaaaatgatccttatgcacgccacctactttctggccgccgtgctcctcggggaccacgcggagcaggtcaacacgttcctgcgtctcgtgtttgagatccccctgtttagcgacgcggccgtgcgccacttccgccagcgcgccaccgtgtttctcgtcccccggcgccacggcaagacctggtttctggtgcccctcatcgcgctgtcgctggcctcctttcgggggatcaagatcggctacacggcgcacatccgcaaggcgaccgagccggtgtttgaggagatcgacgcctgcctgcggggctggttcggttcggcccgagtggaccacgttaaaggggaaaccatctccttctcgtttccggacgggtcgcgcagtaccatcgtgtttgcctccagccacaacacaaacgtaagtcctcttttctttcgcatggctctcccaaggggccccgggtcgacccgacccacacccacccacccacatacacacacaaccagacgcgggaggaaagtctgccccgtgggcactgatttttattcgggatcgcttgaggaggcccgggcaacggcccgggcaacggtggggcaactcgtagcaaataggcgactgatgtacgaagagaagacacacaggcgccacccggcgctggtcggggggatgttgtccgcgccgcaccgtcccccgacgacctcttgcagacggtccgtgatgcaaggacggcggggggcctgcagcagggtgaccgtatccacgggatggccaaagagaagcggacacaggctagcatccccctggaccgccagggtacactgggccatcttggcccacagacacggggcgacgcagggacaggactccgttacgacggaggagagccacagtgcgttggcggaatcgatgtggggcggcggggcgcaggactcgcagccccccgggtggttggtgatcctggccaggagccatcccagatggcgggccctgcttcccggtggacagagcgaccccaggtcgctgtccatggcccagcagtagatctggccgctggggaggtgccaccaggcccccgggcccaaggcgcagcacgcgcccggctccgggggggtcttcgcggggaccagatacgcgccatccagctcgccgaccactggctcctccgcgagctgttcggtggttgggtcgggggtttcctccgggggggtggccgcccgtatgcgtgcgaacgtgagggtgcacaggagcggggtcagggggtgcgtcacgctccggaggtggacgatcgcgcagtagcggcgctcgcggttaaagaaaaagagggcaaagaaggtgttcgggggcaaccgcagcgccttggggcgcgtcagatacagaaaaatctcgcagaagagggcgcgcccggggtctgggttaggaagggccacctgacacagaggctcggtgaggaccgttagacaccgaaagatcttgagccgctcgtccgcccgaacgacgcgccacacaaagacggagttgacaatgcgcgcgatagagtcgacgtccgtccccaggtcgtcgactctatcgcgcgtgccgcgagctccggcccgggaatccggccggggcaaggtccccgggggaccaggcggcgccaggggccgccggggtcccagctgcgccatgccgggggcggggggagggcaaaccccagaggcgggggccaacggcgcggggaggagtgggtgggcgaggtggccgggggaaggcgcccgctagcgagaccggccgttcccggacgacaccttgcgacaaaacctaaggacagcggcccgcgcgacggggtccgagaggctaaggtaggccgcgatgttaatggtgaacgcaaagccgccgggaaagacaactatgccacagaggcggcgattaaaccccaggcagaggtaggcgtagctttccccgggcaggtattgctcgcagaccctgcgtggggctgtggaggggacggcctccatgaagcgacatttactctgctcgcgtttactgacgtcaccatccatcgccacggcgattggacgattgttaagccgcagcgtgtctccgcttgtgctgtagtagtcaaaaacgtaatggccgtcggagtcggcaaagcgggccgggaggtcgtcgccgagcgggacgacccgccgcccccgaccgccccgtccccccaggtgtgccaggacggccagggcatacgcggtgtgaaaaaaggcgtcgggggcggtcccctcgacggcgcgcatcaggttctcgaggagaatggggaagcgcctggtcacctcccccaaccacgcgcgttggtcggggccaaagtcatagcgcaggcgctgtgagattcgcgggccgccctgaagcgcggcccggatggcctggcccagggcccggaggcacgccagatgtatgcgcgcggtaaaggcgacctcggcggcgatgtcaaagggcggcaggacggggcgcgggtggcgcaggggcacctcgagcgcgggaaagcgtagcagcagctccgcctgcccagcgggagacagctggtgggggcgcacgacgcgttctgcggcgcaggcctcggtcagggccgtggccagcgccgaggacagcagcggagggcgggcgcgtcgcccgccccacgccacggagttctcgtaggagacgacgacgaagcgctgcttggttccgtagtggtggcgcaggaccacggagatagaacgacggctccacagccagtccggccggtcgccgccggccagggcttcccatccgcgatccaaccactcgaccagcgaccgcggctttgcggtaccaggggtaagggttagaacgtcgttcaggatgtcctcgcccccgggcccgtggggcgctggggccacaaagcggcccccgccggggggctccagacccgccagcaccgcatctgcgtcagccgcccccatggcgcccccgctgacggcctggtgaaccagggcgccctggcgtagccccgatgcaacgccacaggccgcacgcccggtccgcgctcggaccgggtggcggcgggtgacgtcctgcactgcccgctgaaccaacgcgaggatctcctcgttctcctgtgcgatggacacgtcctgggccgcggtcgtgtcgccgccgggggccgtcagctgctcctccggggagatgggggggtcggacgccccgacgatgggcgggtctgcgggcgcccccgcgtggggccgggccaagggctgcggacgcggggacgcgctttcccccagacccatggacaggtgggccgcagcctccttcgcggccggcggggcggcggcgccaagcagagcgacgtagcggcacaaatgccgacagacgcgcatgatgcgcgtgctgtcggccgcgtagcgcgtgttgggggggacgagctcgtcgtaactaaacagaatcacgcgggcacagctcgcccccgagccccacgcaaggcgcagcgccgccacggcgtacgggtcatagacgccctgcgcgtcacacaccacgggcagggagacgaacaaccccccggcgctggacgcacgcggaaggaggccagggtgtgccggcacgacgggggccagaagctcccccaccgcatccgcgggcacgtaggcggcaaacgccgtgcaccacggggtacagtcgccggtggcatgagcccgagtctggatttcgacctggaagtttgcggccgtcccgagtccggggcggccgcgcatcagggcggccagagggattcccgcggccgccaggcactcgctggatatgatgacgtgaaccaaagaccgagggccgacccgggccgtggccgagatcgtctggacctcgttggccaagtgcgcgttcatggttcgggggtgggtgtgggtgtgtaggcgatgcgggtcccccgagtccgcgggaagggcgtgggtttggcgcgcgtatgcgtattcgccaacggaggcgtgcgtgcttatgcgcggcgcgtttcttctgtctctagggaatccgaggccaggactttaacctgctctttgtcgacgaggccaactttattcgcccggatgcggtccagacgattatgggctttctcaaccaggccaactgcaagattatcttcgtgtcgtccaccaacaccgggaaggccagtacgagctttttgtacaacctccgcggggccgcagacgagcttctcaacgtggtgacctatatatgcgatgatcacatgccgagggtggtgacgcacacaaacgccacggcctgttcttgttatatcctcaacaagcccgttttcatcacgatggacggggcggttcgccggaccgccgatttgtttctggccgattccttcatgcaggagatcatcgggggccaggccagggagaccggcgacgaccggcccgttctgaccaagtctgcgggggagcggtttctgttgtaccgcccctcgaccaccaccaacagcggcctcatggcccccgatttgtacgtgtacgtggatcccgcgttcacggccaacacccgagcctccgggaccggcgtcgctgtcgtcgggcggtaccgcgacgattatatcatcttcgccctggagcacttttttctccgcgcgctcacgggctcggcccccgccgacatcgcccgctgcgtcgtccacagtctgacgcaggtcctggccctgcatcccggggcgtttcgcggcgtccgggtggcggtcgagggaaatagcagccaggactcggccgtcgccatcgccacgcacgtgcacacagagatgcaccgcctactggcctcggagggggccgacgcgggctcgggccccgagcttctcttctaccactgcgagcctcccgggagcgcggtgctgtacccctttttcctgctcaacaaacagaagacgcccgcctttgaacactttattaaaaagtttaactccgggggcgtcatggcctcccaggagatcgtttccgcgacggtgcgcctgcagaccgacccggtcgagtatctgctcgagcagctaaataacctcaccgaaaccgtctcccccaacactgacgtccgtacgtattccggaaaacggaacggcgcctcggatgaccttatggtcgccgtcattatggccatctacctcgcggcccaggccggacctccgcacacattcgctcctatcacacgcgtctcgtgagcgcccaataaacacacccaggtatgctacgcacgaccacggtgtcgtctgttaaggggggggggggaagggggtgttggcgggaagcgtgggaacacgggggattctctcacgaccggcaccagtaccacccccctgtgaacacagaaaccccaacccaaatcccataaacatacgacacacaggcatattttggaatttcttaggtttttatttatttaggtatgctggggtttctccctggatgcccacccccacccccccgtgggtctagccgggccttagggatagcgtataacgggggccatgtctccggaccgcacaacggccgcgccgtcaaaggtgcacacccgaaccacgggagccagggccaaggtgtctcctagttggcccgcgtgggtcagccaggcgacgagcgcctcgtaaagcggcagccttcgctctccatcctgcatcagggccggggcttcggggtgaatgagctgggcggcctcccgcgtgacactctgcatctgcagtagagcgttcacgtacccgtcctgggcacttagcgcaaagagccgggggattagcgtaaggatgatggtggttccctccgtgatcgagtaaaccatgttaaggaccagcgatcgcagctcggcgtttacgggaccgagttgttggacgtccgccagcagcgagaggcgactcccgttgtagtacagcacgttgaggtctggcagccctccggggtttctggggctggggttcaggtcccggatgcccctggccacgagccgcgccacgatttcgcgcgccaggggcgatggaagcggaacgggaaaccgcaacgtgaggtccagcgaatccaggcgcacgtccgtcgcttggccctcgaacacgggcgggacgaggctgatggggtccccgttacagagatctacgggggaggtgttgcgaaggttaacggtgccggcgtgggtgaggcccacgtccagggggcaggcgacgattcgcgtgggaagcacccgggtgatgaccgcggggaagcgccttcggtacgccagcaacaaccccaacgtgtcgggactgacgcctccggagacgaaggattcgtgcgccacgtcggccagcgtcagttgccggcggatggtcggcaggaataccacccgcccttcgcagcgctgcagcgccgccgcatcggggcgcgagatgcccgagggtatcgcgatgtcagtttcaaagccgtccgccagcatggcgccgatccacgcggcagggagtgcagtggtggttcgggtggcgggaggagcgcggtgggggtcagcggcgtagcagagacgggcgaccaacctcgcataggacggggggtgggtcttagggggttgggaggcgacagggaccccagagcatgcgcggggaggtctgtcgggcccagacgcaccgagagcgaatccgtccgcggagtcccggcttgggttttatggggcccggccctcggaatcgcggcttgtcggcggggacaaagggggcggggctaggggcttgcggaaacagaagacgcgtgggataaaagaatcgcactaccccaaggaagggcggggcggtttattacagagccagtcccttgagcggggatgcgtcatagacgagatactgcgcgaagtgggtctcccgcgcgtgggcttccccgttgcgggcactgcggaggagggcggggtcgctggcgcaggtgagcgggtaggcctcctgaaacaggccacacgggtcctccacgagttcgcggcaccccggggggcgcttaaactgtacgtcgctggcggcggtggccgtggacaccgccgaacccgtctccacgatcaggcgctccaggcagcgatgtttggcggcgatgtcggccgacgtaaagaacttaaagcaggggctgagcaccggcgaggccccgttgaggtggtaggccccgttatagagcaggtccccgtacgaaaatcgctgcgacgcccacgggttggccgtggccgcgaaggcccgggacgggtcgctctggccgtggtcgtacatgagggcggtgacatccccctccttgtcccccgcgtaaacgcccccggcggcgcgtccccgggggttgcagggccggcggaagtagttgacgtcggtcgacacgggggtggcgataaactcacacacggcgtcctggccgtggtccatccctgcgcgccgcggcacctgggcgcacccgaacacggggacgggctgggccggccccaggcggtttcccgccacgaccgcgttccgcaggtacacggctgccgcgttgtccaggagagggggagccccgcggcccaggtaaaagttttggggaaggttgcccatgtcggtgacggggttgcggacggttgccgtggccacgacggcggtgtagcccacgcccaggtccacgttcgcgcgcggctgggtgagcgtgaagtttacccccccgccagtttcgtgccgggccacctggagctggcccaggaagtacgcctccgacgcgcgctccgagaacagcacgttctcagtcacaaagcggtcctgtcggacgacggtgaacccaaacccgggatggaggcccgtcttgagctgatgatgcaaggccacgggactgatcttgaagtaccccgccatgagcgcgtaggtcagcgcgttctccccggccgcgctctcgcggacgtgctgcacgacgggctgtcggatcgacgaaaagtagttggcccccagagccggggggaccagggggacctgccgcgacaggtcgcgcagggccggggggaaattgggcgcgttcgccacgtggtcggccccggcgaacagcgcgtggacggggagggggtaaaaatagtcgccattttggatggtatggtccagatgctggggggccatcagcaggattccggcgtgcaacgccccgtcgaatatgcgcatgttggtggtggacgcggtgttggcgcccgcgtcgggcgccgccgagcagagcagcgccgttgtgcgttcggccatgttgtgggccagcacctgcagcgtgagcatggcgggcccgtccactaccacgcgcccgttgtgaaacatggcgttgaccgtgttggccaccagattggccgggtgcagggggtgcgcggggtccgtcacggggtcgctggggcactcctcgccgggggcgatctccgggaccaccatgttctgcagggtggcgtatacgcggtcgaagcgaacccccgcggtgcagcagcggccccgcgagaaggcgggcaccatcacgtagtagtaaatcttgtggtgcacggtccagtccgccccccggtgcggccggtcatccgcggcgtccgcggctcgggcctgggtgttgtgcagcagctggccgtcgttgcggttgaagtccgcggtcgccacgttacatgccgccgcgtacacggggtcgtggccccccgcgctaacccggcagtcgcgatggcggtccagggccgcgcgccgcatcagggcgtcacagtcccacacgaggggtggcagcagcgccgggtctcgcattaggtgattcagctcggcttgcgcctgcccgcccagctccgggccggtcagggtaaagtcatcaaccagctgggccagggcctcgacgtgcgccaccaggtcccggtacacggccatgcactcctcgggaaggtctcccccgaggtaggtcacgacgtacgagaccagcgagtagtcgttcacgaacgccgcgcaccgcgtgttgttccagtagctggtgatgcactggaccacgagccgggccagggcgcagaagacgtgctcgctgccgtgtatggcggcctgcagcaggtaaaacaccgccgggtagttgcggtcgtcgaacgccccgcgaacggcggcgatggtggcgggggccatggcgtggcgtcccacccccagctccaggccccgggcgtcccggaacgccgccggacatagcgccaggggcaagttgccgttcaccacgcgccaggtggcctggatctcccccgggccggccgggggaacgtccccccccggcagctccacgtcggccacccccacaaagaagtcgaacgcggggtgcagctcaagagccaggttggcgttgtcgggctgcataaactgctccggggtcatctggccttccgcgacccatcggacccgcccgtgggccaggcgctgcccccaggcgttcaaaaacagctgctgcatgtctgcggcggggccggccggggccgccacgtacgccccgtacggattggcggcttcgacggggtcgcggttaaggcccccgaccgccgcgtcaacgttcatcagcgaagggtggcacacggtcccgatcgcgtgttccagagacaggcgcagcacctggcggtccttcccccaaaaaaacagctggcggggcgggaaggcgcggggatccgggtggccgggggcggggactaggtccccggcgtgcgcggcaaaccgttccatgaccggattgaacaggcccaggggcaggacgaacgtcaggtccatggcgcccaccagggggtagggaacgttggtggcggcgtagatgcgcttctccagggcctccagaaagaccagcttctcgccgatggacaccagatccgcgcgcacgcgcgtcgtctggggggcgctctcgagctcgtccagcgtctgccggttcaggtcgagctgctcctcctgcatctccagcaggtggcggcccacgtcgtccagacttcgcacggccttgcccatcacgagcgccgtgaccaggttggccccgttcaggaccatctcgccgtacgtcaccggcacgtcggcttcggtgtcctccactttcaggaaggactgcaggaggcgctgtttgatcggggcggtggtgacgagcaccccgtcgaccggccgcccgcgcgtgtcggcatgcgtcagacggggcacggccacggagggctgcgtggccgtggtgaggtccacgagccaggcctcgacggcctcccggcggtggcccgccttgcccaggaaaaagctcgtctcgcagaagcttcgctttagctcggcgaccagggtcgcccgggccaccctggtggccaggcggccgttgtccaggtatcgttgcatcggcaacaacaaagccaggggcggcgccttttccagcagcacgtgcagcatctggtcggccgtgccgcgctcaaacgccccgaggacggcctggacgttgcgagcgagctgttggatggcgcgcaactggcgatgcgcgccgatacccgtcccgtccagggcctcccccgtgagcagggcgatggcctcggtggccaggctgaaggcggcgttcagggcccggcggtcgataatcttggtcatgtaattgtgtgtgggttgctcgatggggtgcgggccgtcgcgggcaatcagcggctggtggacctcgaactgtacgcgcccctcgttcatgtaggccagctccggaaacttggtacacacgcacgccaccgacaacccgagctccagaaagcgcacgagcgacagggtgttgcaatacgaccccagcagggcgtcgaactcgacgtcgtacaggctgtttgcatcggagcgcacgcgggaaaaaaaatcaaacaggcgtcgatgcgacgccacctcgatcgtgctaaggagggacccggtcggcaccatggccgcggcataccggtatcccggagggtcgcggttgggagcggccatggggtcgcgtggagatcggctgtctctagcgatattggcccggggaggctaagatccaccccaacgcccggccacccgtgtacgtgcccgacggcccaaggtccaccgaaagacacgacgggcccggacccaaaaaggcgggggatgctgtgtgagaggccgggtgccggtcgggggggaaaggcaccgggagaaggctgcggcctcgttccaggagaacccagtgtccccaacagacccggggacgtgggatcccaggccttatatacccccccccccgccccacccccgttagaacgcgacgggtgcattcaagatggccctggtccaaaagcgtgccaggaagaaattggcagaggcggcaaagctgtccgccgccgccacccacatcgaggccccggccgcgcaggctatccccagggcccgtgtgcgcaggggatcggtgggcggcagcatttggttggtggcgataaagtggaaaagcccgtccggactgaaggtctcgtgggcggcggcgaacaaggcacacagggccgtgcctcccaaaaacacggacatcccccaaaacacgggcgccgacaacggcagacgatccctcttgatgttaacgtacaggaggagcgcccgcaccgcccacgtaacgtagtagccgacgatggcggccaggatacaggccggcgccaccacccttccggtcagcccgtaatacatgcccgctgccaccatctccaacggcttcaggaccaaaaacgaccaaaggaacagaatcacgcgctttgaaaagaccggctgggtatggggcggaagacgcgagtatgccgaactgacaaaaaaatcagaggtgccgtacgaggacaatgaaaactgttcctccagcggcagttctccctcctcccccccgaaggcggcctcgtcgaccagatctcgatccaccagaggaaggtcatcccgcatggtcatggggtgtgcggtggaggtggggagaccgaaaccgcaaagggtcgcttacgtcagcaggatcccgagatcaaagacacccgggttcttgcacaaacaccacccgggttgcatccgcggaggcgagtgttttgataaggccgttccgcgccttgatataacctttgatgttgaccacaaaacccggaatttacgcctacgccccaatgcccacgcaagatgaggtaggtaacccccccgtgggtgtgacgttgcgtttagttcattggaggccaaggggaaaaatggggtggggaggaaacggaaaacccagtaggccgtgtcgggaacacgcccggggttgtcctcaaaaggcagggtccatactacggaagccgtcgttgtattcgagacctgcctgtgcaacgcacgtcggggttgcctgtgtccggttcggcccccaccgcgtgcggcacgcacgaggacgagtccgcgtgctttattggcgttccaagcgttgccctccagtttctgttgtcggtgttcccccatacccacgcccacatccaccgtagggggcctctgggccgtgttacgtcgccgcccgcgatggagcttagctacgccaccaccatgcactaccgggacgttgtgttttacgtcacaacggaccgaaaccgggcctactttgtgtgcggggggtgtgtttattccgtggggcggccgtgtgcctcgcagcccggggagattgccaagtttggtctggtcgttcgagggacaggcccagacgaccgcgtggtcgccaactatgtac

SEQ ID NO: 850 - DNA, 32767 bp, synthetic construct; identical to SEQ ID NO: 843
  misc_feature 1..32767: note = recombinant viral vector ONCR-158
  source 1..32767: mol_type = other DNA

SEQ ID NO: 851 - DNA, 32767 bp, synthetic construct; identical to SEQ ID NO: 849
  misc_feature 1..32767: note = recombinant viral vector ONCR-159
  source 1..32767: mol_type = other DNA

SEQ ID NO: 852 - DNA, 208 bp, synthetic construct
  misc_feature 1..208: note = miRT-1-143_1736
  source 1..208: mol_type = other DNA
ccatatacatacttctttacattccatcctgagctacagtgcttcatctcattgcatacatacttctttacattccaacgtgagctacagtgcttcatctcatccgatacatacttctttacattccacggcgagctacagtgcttcatctcaccttatacatacttctttacattccaaaaagagctacagtgcttcatctcaccat

SEQ ID NO: 853 - DNA, 308 bp, synthetic construct
  misc_feature 1..308: note = miRT-128m-122-219_6793
  source 1..308: mol_type = other DNA
cacgagaattgcgtttggacaatcagacacaaacaccattgtcacactccatcttaaagagaccggttcactgtggatgtcaaacaccattgtcacactccaacttagaattgcgtttggacaatcaagggaaagagaccggttcactgtggccagcaaacaccattgtcacactccaaaacaaagagaccggttcactgtggtacgagaattgcgtttggacaatcagaaaaaagagaccggttcactgtggaatacaaacaccattgtcacactccaacaaagaattgcgtttggacaatcaggtt

SEQ ID NO: 854 - DNA, 308 bp, synthetic construct
  misc_feature 1..308: note = miRT-128m-204-219_9304
  source 1..308: mol_type = other DNA
aagtaaagagaccggttcactgtggaataagaattgcgtttggacaatcaaggtaggcataggatgacaaagggaacagcaaagagaccggttcactgtggggctagaattgcgtttggacaatcacgtaaggcataggatgacaaagggaacgagaaagagaccggttcactgtgggggaagaattgcgtttggacaatcatactaggcataggatgacaaagggaattagaaagagaccggttcactgtggatttagaattgcgtttggacaatcatagaaggcataggatgacaaagggaattgt

SEQ ID NO: 855 - DNA, 324 bp, synthetic construct
  misc_feature 1..324: note = miRT-217-137-126m_3163
  source 1..324: mol_type = other DNA
tatgctacgcgtattcttaagcaataagacttccaatcagttcctgatgcagtacgaccacattattactcacggtacgaaagcctacgcgtattcttaagcaataaccgccacattattactcacggtacgataaatccaatcagttcctgatgcagtaattactacgcgtattcttaagcaataactattccaatcagttcctgatgcagtacccccacattattactcacggtacgagaattccaatcagttcctgatgcagtacagtcacattattactcacggtacgatcaactacgcgtattcttaagcaataaccaa

The invention claimed is:

1. A recombinant oncolytic herpes simplex virus (HSV) comprising
   (i) a first micro-RNA (miRNA) target sequence cassette (miR-TS) cassette inserted into at least one ICP4 gene or at least one ICP4 untranslated region (UTR) and comprising at least 2 target sequences for each of miR-124, miR-1, and miR-143;
   (ii) a second miR-TS cassette inserted into the ICP27 gene or an ICP27 untranslated region (UTR) and comprising at least 2 target sequences for each of miR-128, miR-219a, and miR-122; and
   (iii) a third miR-TS cassette inserted into at least one ICP34.5 gene or at least one ICP34.5 untranslated region (UTR) and comprising at least 2 target sequences for each of miR-219a, miR-204, and miR-128.

2. The recombinant oncolytic herpes simplex virus of claim 1, wherein the recombinant oncolytic HSV further comprises a fourth miR-TS cassette inserted into UL8 and comprising: (a) at least 2 target sequences for each of miR-137, miR-208b, and miR-126; or (b) at least 2 target sequences for each of miR-137, miR-217, and miR-126.

3. The recombinant oncolytic herpes simplex virus of claim 1, wherein replication of the recombinant oncolytic HSV is reduced in a non-cancerous cell compared to the replication of the recombinant oncolytic HSV in a cancerous cell of the same cell type, and wherein the non-cancerous cell and the cancerous cell are selected from the group consisting of a neuronal cell, a cardiac cell, a muscle cell, and a liver cell.

4. The recombinant oncolytic herpes simplex virus of claim 1, wherein:
   (a) the first miR-TS cassette: comprises a nucleic acid sequence that is at least 95% identical to SEQ ID NO: 852; comprises the nucleic acid sequence of SEQ ID NO: 852; or consists of the nucleic acid sequence of SEQ ID NO: 852;
   (b) the second miR-TS cassette: comprises a nucleic acid sequence that is at least 95% identical to SEQ ID NO: 853; comprises the nucleic acid sequence of SEQ ID NO: 853; or consists of the nucleic acid sequence of SEQ ID NO: 853; or
   (c) the third miR-TS cassette: comprises a nucleic acid sequence that is at least 95% identical to SEQ ID NO: 854; comprises the nucleic acid sequence of SEQ ID NO: 854; or consists of the nucleic acid sequence of SEQ ID NO: 854.

5. The recombinant oncolytic herpes simplex virus of claim 2, wherein the fourth miR-TS cassette comprises a nucleic acid sequence that is at least 95% identical to SEQ ID NO: 855; comprises the nucleic acid sequence of SEQ ID NO: 855; or consists of the nucleic acid sequence of SEQ ID NO: 855.

6. The recombinant oncolytic herpes simplex virus of claim 1, wherein each of the miR-TS cassettes is inserted into at least one UTR of said ICP4, ICP27, and ICP34.5 genes, wherein the at least one UTR is selected from a 5' UTR or a 3' UTR.

7. The recombinant oncolytic herpes simplex virus of claim 6, wherein each of the miR-TS cassettes has a length of less than 1000 nucleotides.

8. The recombinant oncolytic herpes simplex virus of claim 1, further comprising a heterologous polynucleotide sequence encoding one or more payload molecules.

9. The recombinant oncolytic herpes simplex virus of claim 8, wherein the heterologous polynucleotide sequence encodes the payload molecule selected from the group consisting of IL-12, CCL4, and CXCL10.

10. The recombinant oncolytic herpes simplex virus of claim 8, wherein the payload molecule comprises (a) an anti-FAP/anti-CD3 bispecific T cell engager or (b) an anti-PD1-Fc-41BBL protein.

11. A nucleic acid molecule encoding the recombinant oncolytic herpes simplex virus of claim 1.

12. A viral stock comprising the recombinant oncolytic herpes simplex virus of claim 1.

13. A composition comprising the recombinant oncolytic herpes simplex virus of claim 1 and a pharmaceutically acceptable carrier.

14. A method for killing a cancerous cell, comprising exposing the cancerous cell to the recombinant oncolytic herpes simplex virus of claim 1 under conditions sufficient for the oncolytic virus to infect and replicate within said cancerous cell, and wherein replication of the oncolytic virus within the cancerous cell results in cell death.

15. The method of claim 14, wherein the cancerous cell has a reduced expression of a miRNA capable of binding to the one or more miRNA target sequences compared to the expression of the miRNA in a non-cancerous cell, and wherein the expression level of the miRNA in the cancerous cell is at least 5% less than the expression level the miRNA in the non-cancerous cell.

16. The method of claim 14, wherein replication of the oncolytic virus is increased or maintained in cancerous cells with a reduced expression of the miRNA capable of binding to the one or more miRNA target sequences, and wherein the viral replication is at least 5% greater in the cancerous cells compared to the viral replication in the non-cancerous cell.

17. The method of claim 14, wherein the cell is in vivo.

18. The method of claim 14, wherein the cell is within a tumor.

19. A method for treating cancer in a subject in need thereof, comprising administering the recombinant oncolytic herpes simplex virus of claim 1 or a composition thereof.

20. The method of claim 19, wherein the subject is a mouse, a rat, a rabbit, a cat, a dog, a horse, a non-human primate, or a human.

21. The method of claim 19, wherein the oncolytic virus or the composition thereof is administered intravenously, subcutaneously, intratumorally, intramuscularly, or intranasally.

22. The method of claim 19, wherein the cancer is selected from lung cancer, breast cancer, ovarian cancer, cervical cancer, prostate cancer, testicular cancer, colorectal cancer, colon cancer, pancreatic cancer, liver cancer, gastric cancer, head and neck cancer, thyroid cancer, malignant glioma, glioblastoma, melanoma, B-cell chronic lymphocytic leukemia, diffuse large B-cell lymphoma (DLBCL), and marginal zone lymphoma (MZL).

23. The method of claim 22, wherein the lung cancer is small cell lung cancer or non-small cell lung cancer, or wherein the liver cancer is hepatocellular carcinoma (HCC).

\* \* \* \* \*